United States Patent
Zhang

(10) Patent No.: US 12,258,594 B2
(45) Date of Patent: Mar. 25, 2025

(54) CAS PROTEINS WITH REDUCED IMMUNOGENICITY AND METHODS OF SCREENING THEREOF

(71) Applicants: THE BROAD INSTITUTE, INC., Cambridge, MA (US); MASSACHUSETTS INSTITUTE OF TECHNOLOGY, Cambridge, MA (US)

(72) Inventor: Feng Zhang, Cambridge, MA (US)

(73) Assignees: THE BROAD INSTITUTE, INC., Cambridge, MA (US); MASSACHUSETTS INSTITUTE OF TECHNOLOGY, Cambridge, MA (US)

(*) Notice: Subject to any disclaimer, the term of this patent is extended or adjusted under 35 U.S.C. 154(b) by 0 days.

(21) Appl. No.: 16/704,857

(22) Filed: Dec. 5, 2019

(65) Prior Publication Data

US 2020/0199555 A1 Jun. 25, 2020

Related U.S. Application Data

(60) Provisional application No. 62/775,839, filed on Dec. 5, 2018, provisional application No. 62/775,832, filed on Dec. 5, 2018, provisional application No. 62/775,860, filed on Dec. 5, 2018, provisional application No. 62/775,855, filed on Dec. 5, 2018, provisional application No. 62/775,877, filed on Dec. 5, 2018, provisional application No. 62/775,812, filed on Dec. 5, 2018.

(51) Int. Cl.
C12N 9/22 (2006.01)
C12N 15/90 (2006.01)

(52) U.S. Cl.
CPC ............ *C12N 9/22* (2013.01); *C12N 15/907* (2013.01); *C12N 2310/20* (2017.05)

(58) Field of Classification Search
CPC ..... C12N 15/907; C12N 2310/20; C12N 9/22
See application file for complete search history.

(56) References Cited

U.S. PATENT DOCUMENTS

| | | | | |
|---|---|---|---|---|
| 11,208,640 B2* | 12/2021 | Ewaisha | ............... | C12N 9/22 |
| 11,566,052 B2* | 1/2023 | Payne | ................ | C12N 15/86 |
| 2018/0319850 A1* | 11/2018 | Payne | ................ | C12N 9/22 |
| 2020/0172931 A1* | 6/2020 | Liu | ................ | C07K 14/32 |

FOREIGN PATENT DOCUMENTS

| | | |
|---|---|---|
| WO | 2014/093622 A2 | 6/2014 |
| WO | 2019/005884 A1 | 1/2019 |
| WO | 2019/005886 A1 | 1/2019 |
| WO | 2019/060746 A1 | 3/2019 |
| WO | 2019/071048 A1 | 4/2019 |
| WO | 2019/084013 A1 | 5/2019 |
| WO | 2019/084062 A1 | 5/2019 |

OTHER PUBLICATIONS

Chew et al., A multi-functional AAV-CRISPR-Cas9 and its host response. Nature Methods, 2016, vol. 13(10): 868-874. (Year: 2016).*
Chew WL., Immunity to CRISPR Cas9 and Cas12 therapeutics. WIREs Syst Biol Med., 2018, 10:e1408, pp. 1-23. (Year: 2018).*
Moreno et al., Exploring protein orthogonality in immune space: a case study with AAV and Cas9 orthologs. bioRxiv, version posted Jan. 10, 2018, pp. 1-24). (Year: 2018).*
De Groot et al., De-immunization of therapeutic proteins by T-cell epitope modification. Dev. Biol., (Basel), Basel, Krager, 2005, vol. 122: 171-194. (Year: 2005).*
Fridman et al., An efficient T-cell epitope discovery strategy using in silico prediction and the iTopia assay platform. OncoImmunology, 2012, vol. 1:8: 1258-1270. (Year: 2012).*
Ogishi et al., The landscape of T cell epitope immunogenicity in sequence space. bioRxiv preprint this version posted Oct. 9, 2018, pp. 1-63. (Year: 2018).*
Vaughan et al., Deciphering the MHC-associated peptidome: a review of naturally processed ligand data. Expert Review of Proteomics, 2017, vol. 14, (9): 729-736. (Year: 2017).*
Hu et al., Evolved Cas9 variants with broad PAM compatibility and high DNA specificity. Nature, 2018, vol. 556: 57-63. (Year: 2018).*
Ferdosi SR., Genome-Driven Targeted Cancer Therapy. Ph.D., Thesis, Arizona State University, Dec. 2017, pp. 1-118. (Year: 2017).*
Abelin, et al., "Mass Spectrometry Profiling of HLA-Associated Peptidomes in Mono-allelic Cells Enables More Accurate Epitope Prediction", Immunity, vol. 46, Issue 2, Feb. 21, 2017, 315-326.
Atanasova, et al., "EpiDOCK: A Molecular Docking-Based Tool for MHC Class II Binding Prediction", Protein Engineering, Design and Selection, vol. 26, No. 10, May 9, 2013, 631-634.
Barra, et al., "Footprints of Antigen Processing Boost MHC Class II Natural Ligand Predictions", Genome Medicine, vol. 10, No. 84, 2018, 15 pages.
Bhasin, et al., "A Hybrid Approach for Predicting Promiscuous MHC Class I Restricted T Cell Epitopes", Journal of Biosciences, vol. 31, No. 1, Jan. 2007, 31-42.
Bhasin, et al., "SVM Based Method for Predicting HLA-DRB1*0401 Binding Peptides in an Antigen Sequence", Bioinformatics, vol. 20, No. 3, 2004, 421-423.
Canver, et al., "BCL11A Enhancer Dissection by Cas9-Mediated In Situ Saturating Mutagenesis", Nature, vol. 527, Nov. 12, 2015, 192-197.

(Continued)

*Primary Examiner* — Ganapathirama Raghu
(74) *Attorney, Agent, or Firm* — F. Brent Nix, Esq.; Johnson, Marcou, Isaacs & Nix, LLC

(57) ABSTRACT

The present disclosure generally relates to systems, methods and compositions related to Clustered Regularly Interspaced Short Palindromic Repeats (CRISPR) and components thereof. The present disclosure also relates to methods, systems, and compostions modified to reduce immunogenicity. Additionally, the present disclosure relates to methods for developing or designing CRISPR-Cas system based therapy or therapeutics.

14 Claims, No Drawings

Specification includes a Sequence Listing.

(56) References Cited

OTHER PUBLICATIONS

Chen, et al., "Genome-Wide CRISPR Screen in a Mouse Model of Tumor Growth and Metastasis", Cell, vol. 160, No. 6, Mar. 12, 2015, 1246-1260.
Choi, et al., "EpiSweep: Computationally Driven Reengineering of Therapeutic Proteins to Reduce Immunogenicity While Maintaining Function", Methods in Molecular Biology, vol. 1529, 2017, 375-398.
Cong, et al., "Multiplex Genome Engineering Using CRISPR/Cas Systems", Science, vol. 339, No. 6121, Feb. 15, 2013, 819-823.
Dhanda, et al., "Development of a Strategy and Computational Application to Select Candidate Protein Analogues with Reduced HLA Binding and Immunogenicity", Immunology, vol. 153, No. 1, 2018, 118-132.
Dhanda, et al., "Prediction of IL4 Inducing Peptides", Clinical and Developmental Immunology, vol. 2013, Article 263952, 2013, 9 pages.
Dimitrov, et al., "EpiTOP—A Proteochemometric Tool for MHC Class II Binding Prediction", Bioinformatics, vol. 26, No. 16, 2010, 2066-2068.
Doench, et al., "Rational Design of Highly Active SgRNAs for CRISPR-Cas9-Mediated Gene Inactivation", Nature Biotechnology, vol. 32, No. 12, Dec. 2014, 1262-1267.
Donnes, et al., "Integrated Modeling of the Major Events in the MHC Class I Antigen Processing Pathway", Protein Science, vol. 14, No. 8, 2005, 2132-2140.
Donnes, et al., "Prediction of MHC Class I Binding Peptides, using Svmhc", BMC Bioinformatics, vol. 3, No. 25, Sep. 2002, 8 pages.
Doytchinova, et al., "EpiJen: A Server for Multistep T Cell Epitope Prediction", BMC Bioinformatics, vol. 7, Article No. 131, Feb. 2006, 11 pages.
Gao, et al., "Engineered Cpf1 Enzymes with Altered PAM Specificities", Nature Biotechnology, vol. 35, No. 8, Dec. 4, 2016, 1-17.
Gfeller, et al., "Predicting Antigen Presentation-What Could We Learn From a Million Peptides?", Frontiers in Immunology, vol. 9, Article 1716, Jul. 2018, 17 pages.
Guan, et al., "MHCPred: A Server for Quantitative Prediction of Peptide-MHC Binding", Nucleic Acids Research, vol. 31, No. 13, Aug. 2003, 3621-3624.
Hakenberg, et al., "MAPPP: MHC Class I Antigenic Peptide Processing Prediction", Applied Bioinformatics, vol. 2, No. 3, 2003, 155-158.
He, et al., "Vaxign: The First Web-Based Vaccine Design Program for Reverse Vaccinology and Applications for Vaccine Development", Journal of Biomedicine and Biotechnology, vol. 2010, Article 297505, 2010, 15 pages.
Hsu, et al., "Development and Applications of CRISPR-Cas9 for Genome Engineering", Cell, vol. 157, No. 6, Jun. 5, 2014, 1262-1278.
Hsu, et al., "DNA Targeting Specificity of RNA-Guided Cas9 Nucleases", Nature Biotechnology, vol. 31, No. 9, Sep. 2013, 827-832.
Hu, et al., "Evolved Cas9 Variants with Broad PAM Compatibility and High DNA Specificity", Nature, vol. 556, No. 7699, Apr. 5, 2018, 57-63.
Jensen, et al., "Improved Methods for Predicting Peptide Binding Affinity to MHC Class II Molecules", Immunology, vol. 154, No. 3, 2018, 394-406.
Jiang, et al., "RNA-Guided Editing of Bacterial Genomes Using CRISPR-Cas Systems", Nature Biotechnology, vol. 31, No. 3, Mar. 2013, 233-239.
Jurtz, et al., "NetMHCpan 4.0: Improved Peptide-MHC Class I Interaction Predictions Integrating Eluted Ligand and Peptide Binding Affinity Data", Journal of Immunology, vol. 199, No. 9, Nov. 2017, 3360-3368.
Konermann, et al., "Genome-Scale Transcriptional Activation by an Engineered CRISPR-Cas9 Complex", Nature, vol. 517, No. 7536, Jan. 29, 2015, 583-588.
Konermann, et al., "Optical Control of Mammalian Endogenous Transcription and Epigenetic States", Nature, vol. 500, No. 7463, Aug. 22, 2013, 472-476.
Larsen, et al., "An Integrative Approach to CTL Epitope Prediction: A Combined Algorithm Integrating MHC Class I Binding, TAP Transport Efficiency, and Proteasomal Cleavage Predictions", European Journal of Immunology, vol. 35, 2005, 2295-2303.
Liu, et al., "Quantitative Prediction of Mouse Class I MHC Peptide Binding Affinity Using Support Vector Machine Regression (SVR) Models", BMC Bioinformatics, vol. 7, Article No. 182, 2006, 13 pages.
Molero-Abraham, et al., "Selection of Conserved Epitopes from Hepatitis C Virus for Pan-Populational Stimulation of T-Cell Responses", Clinical and Developmental Immunology, vol. 2013, Article ID 601943, 2013, 10 pages.
Nielsen, et al., "NetMHCpan, A Method for Quantitative Predictions of Peptide Binding to Any HLA-A and -B Locus Protein of Known Sequence", PLoS One, vol. 2, Issue 8, e796, Aug. 2007, 10 pages.
Nielsen, et al., "Prediction of MHC Class II Binding Affinity Using SMM-Align, A Novel Stabilization Matrix Alignment Method", BMC Bioinformatics, vol. 8, Article No. 238, 2007, 12 pages.
Nielsen, et al., "Quantitative Predictions of Peptide Binding to Any HLA-DR Molecule of Known Sequence: NetMHCIIpan", PLoS Computational Biology, vol. 4, Issue 7, Jul. 2008, 10 pages.
Nielsen, et al., "Reliable Prediction of T-Cell Epitopes Using Neural Networks with Novel Sequence Representations", Protein Science, vol. 12, No. 5, 2003, 1007-1017.
Nishimasu, et al., "Crystal Structure of Cas9 in Complex with Guide RNA and Target DNA", Cell, vol. 156, No. 5, Feb. 27, 2014, 935-949.
Nishimasu, et al., "Crystal Structure of *Staphylococcus aureus* Cas9", Cell, vol. 162, No. 5, Aug. 27, 2015, 1113-1126.
Oyarzun, et al., "PREDIVAC: CD4+ T-Cell Epitope Prediction for Vaccine Design that Covers 95% of HLA Class II DR Protein Diversity", BMC Bioinformatics, vol. 14, Article No. 52, 2013, 11 pages.
Parker, et al., "Scheme for Ranking Potential HLA-A2 Binding Peptides Based on Independent Binding of Individual Peptide Side-Chains", The Journal of Immunology, vol. 152, No. 1, Jan. 1, 1994, 163-175.
Parker, et al., "Structure-Guided Deimmunization of Therapeutic Proteins", Journal of Computational Biology, vol. 20, No. 2, Feb. 2013, 152-165.
Parnas, et al., "A Genome-Wide CRISPR Screen in Primary Immune Cells to Dissect Regulatory Networks", Cell, vol. 162, No. 3, Jul. 30, 2015, 675-686.
Platt, et al., "CRISPR-Cas9 Knockin Mice for Genome Editing and Cancer Modeling", Cell, vol. 159, No. 2, Oct. 9, 2014, 440-455.
Ramanan, et al., "CRISPR/Cas9 Cleavage of Viral DNA Efficiently Suppresses Hepatitis B Virus", Scientific Reports, vol. 5, No. 10833, Jun. 2, 2015, 9 pages.
Rammensee, et al., "SYFPEITHI: Database for MHC Ligands and Peptide Motifs", Immunogenetics, vol. 50, 1999, 213-219.
Ran, et al., "Double Nicking by RNA-Guided CRISPR Cas9 for Enhanced Genome Editing Specificity", Cell, vol. 154, No. 6, Sep. 12, 2013, 1380-1389.
Ran, et al., "Genome Engineering Using the CRISPR-Cas9 System", Nature Protocols, vol. 8, No. 11, Nov. 2013, 2281-2308.
Ran, et al., "In Vivo Genome Editing Using *Staphylococcus aureus* Cas9", Nature, vol. 520, No. 7546, Apr. 9, 2015, 186-191.
Reche, et al., "Enhancement to the RANKPEP Resource for the Prediction of Peptide Binding to MHC Molecules using Profiles", Immunogenetics, vol. 56, No. 6, Oct. 2004, 405-419.
Reche, et al., "PEPVAC: A Web Server for Multi-Epitope Vaccine Development Based on the Prediction of Supertypic MHC Ligands", Nucleic Acids Research, vol. 33, 2005, W138-W142.
Zhang, et al., "MULTIPRED2: A Computational System for Large-Scale Identification of Peptides Predicted to Bind to HLA Supertypes and Alleles", Journal of Immunological Methods, vol. 374, No. 1-2, Nov. 30, 2011, 53-61.
Sanchez-Trincado, et al., "Fundamentals and Methods for T- and B-Cell Epitope Prediction", Journal of Immunology, vol. 2017, Article 2680160, Dec. 28, 2017, 14 pages.

(56) References Cited

OTHER PUBLICATIONS

Shalem, et al., "Genome-Scale CRISPR-Cas9 Knockout Screening in Human Cells", Science, vol. 343, No. 6166, Jan. 3, 2014, 84-87.
Shalem, et al., "High-Throughput Functional Genomics Using CRISPR-Cas9", Nature Reviews Genetics, vol. 16, No. 5, May 2015, 299-311.
Shmakov, et al., "Discovery and Functional Characterization of Diverse Class 2 CRISPR-Cas Systems", Molecular Cell, vol. 60, No. 3, Nov. 5, 2015, 385-397.
Singh, et al., "Propred: Prediction of HLA-DR Binding Sites", Bioinformatics, vol. 17, No. 12, Dec. 2001, 1236-1237.
Singh, et al., "Propred1: Prediction of Promiscuous MHC Class-I Binding Sites", Bioinformatics, vol. 19, No. 8, Jun. 2003, 1009-1014.
Slaymaker, et al., "Rationally Engineered Cas9 Nucleases with Improved Specificity", Science, vol. 351, No. 6268, Jan. 1, 2016, 84-88.
Sturniolo, et al., "Generation of Tissue-Specific and Promiscuous HLA Ligand Databases Using DNA Microarrays and Virtual HLA Class II Matrices", Nature Biotechnology, vol. 17, Jun. 1999, 555-561.
Swiech, et al., "In Vivo Interrogation of Gene Function in the Mammalian Brain Using CRISPR-Cas9", Nature Biotechnology, vol. 33, No. 1, Jan. 2015, 102-106.
Wang, et al., "A Systematic Assessment of MHC Class II Peptide Binding Predictions and Evaluation of a Consensus Approach", PLOS Computational Biology, vol. 4, No. 4, e1000048, 2008, 10 pages.
Wang, et al., "Genetic Screens in Human Cells Using the CRISPR/Cas9 System", Science, vol. 343, No. 6166, Jan. 3, 2014, 80-84.
Wang, et al., "One-Step Generation of Mice Carrying Mutations in Multiple Genes by CRISPR/Cas-Mediated Genome Engineering", Cell, vol. 153, No. 4, May 9, 2013, 910-918.
Wu, et al., "Genome-Wide Binding of the CRISPR Endonuclease Cas9 in Mammalian Cells", Nature Biotechnology, vol. 32, No. 7, Jul. 2014, 670-676.
Xu, et al., "Sequence Determinants of Improved CRISPR SgRNA Design", Genome Research, vol. 25, No. 8, Aug. 2015, 1147-1157.
Zetsche, et al., "A Split-Cas9 Architecture for Inducible Genome Editing and Transcription Modulation", Nature Biotechnology, vol. 33, No. 2, Feb. 2015, 139-142.
Zetsche, et al., "Cpf1 is a Single RNA-Guided Endonuclease of a Class 2 CRISPR-Cas System", Cell, vol. 163, No. 3, Oct. 22, 2015, 759-771.
Zhang, et al., "Immune Epitope Database Analysis Resource (IEDB-AR)", Nucleic Acids Research, vol. 36, Aug. 2008, W513-W518.

* cited by examiner

CAS PROTEINS WITH REDUCED IMMUNOGENICITY AND METHODS OF SCREENING THEREOF

CROSS-REFERENCE TO RELATED APPLICATIONS

This application claims the benefit of U.S. Provisional Application No. 62/775,839, filed Dec. 5, 2018, U.S. Provisional Application No. 62/775,832, filed Dec. 5, 2018, U.S. Provisional Application No. 62/775,860, filed Dec. 5, 2018, U.S. Provisional Application No. 62/775,855, filed Dec. 5, 2018, U.S. Provisional Application No. 62/775,877, filed Dec. 5, 2018, and U.S. Provisional Application No. 62/775,812, filed Dec. 5, 2018. The entire contents of the above-identified applications are hereby fully incorporated herein by reference.

STATEMENT AS TO FEDERALLY SPONSORED RESEARCH

This invention was made with government support under Grant Nos. MH100706, MH 110049, and HL141201 awarded by the National Institutes of Health. The government has certain rights in the invention.

REFERENCE TO AN ELECTRONIC SEQUENCE LISTING

The contents of the electronic sequence listing ("BROD-4450US_Corrected_ST25.txt"; size is 1,746,644 bytes and it was created on Aug. 13, 2024) is herein incorporated by reference in its entirety.

TECHNICAL FIELD

The subject matter disclosed herein generally relates to systems, methods and compositions related to Clustered Regularly Interspaced Short Palindromic Repeats (CRISPR) and components thereof. The present invention also generally relates to methods, systems, and compositions modified to reduce immunogenicity. Additionally, the present invention relates to methods for developing or designing CRISPR-Cas system based therapy or therapeutics.

BACKGROUND

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that employ novel strategies and molecular mechanisms and are affordable, easy to set up, scalable, and amenable to targeting multiple positions within the eukaryotic genome. This would provide a major resource for new applications in genome engineering and biotechnology.

The CRISPR-Cas systems of bacterial and archaeal adaptive immunity show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important.

The development of CRISPR-Cas RNA-guided endonucleases for eukaryotic genome editing has sparked intense interest in the use of this technology for therapeutic applications. Extensive research has led to the identification of different technologies which can address the challenges of safety and efficacy. There are still challenges to overcome in the development of CRISPR-based therapeutics, including immunogenicity of CRISPR-Cas9 in order to allow the translation of these genome editing technologies to the clinic.

Citation or identification of any document in this application is not an admission that such document is available as prior art to the present invention.

SUMMARY

In one aspect, the present disclosure provides a method of reducing immunogenicity of a Cas protein which comprises mutating one or more immunogenic T cell epitopes.

In some embodiments, T cell epitopes are ordered by determining immunogenicity and one or more of the ten most immunogenic T cell epitopes are mutated. In some embodiments, determining immunogenicity comprises measuring affinity of a peptide containing the epitope for one or more MHC molecule. In some embodiments, determining immunogenicity comprises comparing a peptide containing the epitope to a host proteome. In some embodiments, the method comprises mutating Cas proteins containing one or more mutations at one or more amino acid positions and screening the mutant proteins for one or more Cas activities. In some embodiments, the mutating and screening are performed using a phage display system. In some embodiments, the mutating and screening are performed using phage-assisted continuous evolution (PACE). In some embodiments, the nuclease activity of the Cas protein is preserved. In some embodiments, one or more active site residues are unchanged. In some embodiments, one or more residues that determine complex formation with a guide are unchanged. In some embodiments, the target specificity of a CRISPR system comprising the Cas protein is maintained or increased. In some embodiments, the method comprises deleting, inserting, or mutating one or more amino acids in the immunogenic T cell epitope. In some embodiments, the identification of a T cell epitope comprises determining the sequence of one or more peptides from the Cas protein that bind to an MHC receptor. In some embodiments, the identification of a T cell epitope comprises comparison of the CRISPR protein to a database of peptides that bind to an MHC receptor. In some embodiments, the comparison is in silico. In some embodiments, the MHC receptor is a class I MHC receptor. In some embodiments, the MHC receptor is a class II MHC receptor.

In some embodiments, the engineered Cas protein is a class 2 Cas protein. In some embodiments, the engineered Cas protein is Type II, Type V, or Type VI Cas protein. In some embodiments, the Cas protein comprises Cas9, Cas12a, Cas12b, Cas13a, Cas13b, or Cas13c.

In some embodiments, the Cas protein is associated with a functional domain. In some embodiments, the functional domain comprises a mutation that reduces immunogenicity. In some embodiments, the functional domain comprises an activator, a repressor, or a DNA methylase. In some embodiments, the functional domain comprises a base editor.

In another aspect, the present disclosure provides an engineered Cas protein which comprises at least one mutated T cell epitope, wherein the T cell epitope has reduced immunogenicity as compared to the corresponding T cell epitope of a naturally occurring Cas protein, whereby the engineered Cas protein comprises reduced immunogenicity as compared to the naturally occurring Cas protein. In some embodiments, the immunogenicity of the T cell epitope is measured in silico. In some embodiments, the immunogenicity of the CRISPR protein is measured in a host.

In another aspect, the present disclosure provides a polypeptide comprising an engineered Cas protein having reduced immunogenicity compared to a naturally occurring Cas protein. In some embodiments, the Cas protein comprises at least one T cell epitope mutation. In some embodiments, the mutation comprises an insertion, deletion, or substitution. In some embodiments, the Cas protein is glycosylated. In some embodiments, the polypeptide comprises one or more nuclear localization signals (NLS).

In some embodiments, the engineered Cas protein comprises a Cas nuclease catalytic site. In some embodiments, the engineered Cas protein is a nickase. In some embodiments, the engineered Cas protein is catalytically inactive. In some embodiments, the engineered Cas protein is a class 2 Cas protein. In some embodiments, the engineered Cas protein is Type II, Type V, or Type VI Cas protein. In some embodiments, the engineered Cas protein is Cas9, Cas12, or Cas13.

In some embodiments, the Cas protein is Cas9. In some embodiments, the Cas9 is from Corynebacter, Sutterella, *Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor*, or *Campylobacter*. In some embodiments, the Cas9 comprises a mutation at D10, E762, H840, N854, N863, or D986 with reference to the position numbering of a *Streptococcus pyogenes* Cas9. In some embodiments, the mutation comprises D10A, E762A, H840A, N854A, N863A or D986A.

In some embodiments, the Cas protein is Cas12a. In some embodiments, the Cas12a is from *Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, Candidatus Methanoplasma *termitum, Eubacterium eligens, Moraxella bovoculi* 237, *Leptospira inadai*, Lachnospiraceae bacterium ND2006, *Porphyromonas crevioricanis* 3, *Prevotella disiens*, or *Porphyromonas macacae*.

In some embodiments, the Cas protein is Cas12b. In some embodiments, the Cas12b is from *Alicyclobacillus, Desulfovibrio, Desulfonatronum*, Opitutaceae, *Tuberibacillus, Bacillus, Brevibacillus, Candidatus, Desulfatirhabdium*, Elusimicrobia, *Citrobacter, Methylobacterium*, Omnitrophicai, Phycisphaerae, Planctomycetes, Spirochaetes, or Verrucomicrobiaceae. In some embodiments, the Cas12b comprises a mutation at R911, R1000, or R1015 with reference to the position numbering of a *Alicyclobacillus acidoterrestris* Cas12b.

In some embodiments, the Cas protein is Cas13. In some embodiments, the Cas13 is from *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium*, Corynebacter, Carnobacterium, *Rhodobacter, Listeria, Paludibacter, Clostridium*, Lachnospiraceae, Clostridiaridium, Leptotrichia, *Francisella, Legionella, Alicyclobacillus, Methanomethyophilus, Porphyromonas, Prevotella*, Bacteroidetes, Helcococcus, Letospira, *Desulfovibrio, Desulfonatronum*, Opitutaceae, *Tuberibacillus, Bacillus, Brevibacilus, Methylobacterium* or *Acidaminococcus*.

In another aspect, the present disclosure provides a nucleic acid encoding the engineered Cas protein herein.

In another aspect, the present disclosure provides a cell comprising the nucleic acid herein.

In another aspect, the present disclosure provides a composition comprising an engineered Cas protein or a nucleotide sequence encoding the Cas protein, and at least one guide designed to form a complex with the Cas protein or at least one nucleotide sequence encoding the at least one guide, wherein the guide is designed to hybridize with a target sequence of a DNA molecule in a cell. In some embodiments, the Cas protein is Cas9, Cas12, or Cas13. In some embodiments, the Cas protein comprises one or more nuclear localization signals (NLSs). In some embodiments, the guide comprises a chimeric RNA. In some embodiments, the guide comprises a crRNA and a tracrRNA. In some embodiments, the composition further comprises a homologous recombination (HR) template. In some embodiments, the Cas protein is associated with one or more functional domains. In some embodiments, the Cas protein is associated with one or more functional domains; and the Cas protein comprises one or more mutations within a RuvC and/or Nuc domain, whereby the complex can deliver an epigenetic modifier or a transcriptional or translational activation or repression signal. In some embodiments, the Cas protein is associated with adenosine deaminase or cytidine deaminase. In some embodiments, the cell is a mammalian cell. In some embodiments, the cell is a human cell. In some embodiments, the Cas protein is Cas13, and optionally the Cas13 comprises one or more mutations within an HEPN domain, such as R597A, H602A, R1278A, and/or H1283A, whereby the complex can deliver an epigenetic modifier or a transcriptional or translational activation or repression signal.

In another aspect, the present disclosure provides a vector system for providing the composition herein, which comprises one or more vectors comprising: a first regulatory element operably linked to a nucleotide sequence encoding a deimmunized Cas protein, and i) a) a second regulatory element operably linked to a nucleotide sequence encoding the crRNA, and b) a third regulatory element operably linked to a nucleotide sequence encoding the tracrRNA, ii) a second regulatory element operably linked to a nucleotide sequence encoding the crRNA and the tracr RNA, or iii) a second regulatory element operably linked to a nucleotide sequence encoding a guide sequence.

In some embodiments, the nucleotide sequence encoding the Cas protein is codon optimized for expression in a eukaryotic cell. In some embodiments, the one or more vectors comprise one or more viral vectors. In some embodiments, the one or more vectors comprise one or more retroviral, lentiviral, adenoviral, adeno-associated or herpes simplex viral vectors.

In another aspect, the present disclosure provides a delivery system configured to deliver an engineered Cas protein having reduced immunogenicity compared to a naturally occurring Cas protein and one or more nucleic acid components of a composition comprising: a) the engineered Cas protein, and b) i) a crRNA comprising a) a 5' guide sequence designed to hybridize to a target DNA sequence, and b) a 3' direct repeat sequence, and ii) a tracr RNA, or a guide, whereby there is formed a CRISPR complex comprising the Cas protein complexed with the crRNA and the tracr RNA, or the guide.

In some embodiments, the Cas protein is a Type II, Type V, or Type VI Cas protein. In some embodiments, the Cas protein is Cas9, Cas12, or Cas13. In some embodiments, the delivery system comprises one or more vectors or one or more polynucleotide molecules, the one or more vectors or polynucleotide molecules comprising one or more polynucleotide molecules encoding the Cas protein and one or more nucleic acid components of the non-naturally occurring or engineered composition. In some embodiments, the delivery system comprises a delivery vehicle comprising liposome(s), particle(s), exosome(s), microvesicle(s), a gene-gun or one or more viral vector(s).

In another aspect, the present disclosure provides an engineered Cas protein which comprises at least one mutated T cell epitope, wherein the T cell epitope has reduced immunogenicity as compared to the corresponding T cell epitope of a naturally occurring Cas protein, whereby the engineered Cas protein comprises reduced immunogenicity as compared to the naturally occurring Cas protein.

In some embodiments, the Cas protein is wherein the Cas protein is a Type II, Type V, or Type VI Cas protein. In some embodiments, the Cas protein is Cas9, Cas12, or Cas13. In some embodiments, the immunogenicity of the T cell epitope is measured in silico. In some embodiments, the immunogenicity of the Cas protein is measured in a host.

In another aspect, the present disclosure provides a method of modifying a target nucleic acid, the method comprising contacting the target DNA with one or more engineered compositions comprising: a) an engineered Cas protein herein, having reduced immunogenicity compared to a naturally occurring Cas protein, b i) a crRNA comprising a) a guide sequence designed to hybridize to the target DNA sequence, and b) a direct repeat sequence, and ii) optionally a tracr RNA, or a guide, whereby there is formed a CRISPR complex comprising the Cas protein complexed with the crRNA and, optionally, with the tracr RNA, or the guide, wherein the guide sequence directs sequence-specific binding to the target DNA sequence in a cell, whereby expression of the target locus of interest is modified.

In some embodiments, modifying expression of the target gene comprises cleaving the target nucleic acid. In some embodiments, modifying expression of the target gene comprises increasing or decreasing expression of the target nucleic acid. In some embodiments, the target nucleic acid is DNA or RNA. In some embodiments, the target gene is in a prokaryotic cell. In some embodiments, the target gene is in a eukaryotic cell. In some embodiments, the target gene is in a mammalian cell or a human cell.

In another aspect, the present disclosure provides a cell comprising a modified target of interest, wherein the target of interest has been modified according to the method herein.

In another aspect, the present disclosure provides a method of modifying a target DNA in a mammal, which comprises delivering the system herein. In some embodiments, the mammal is a human, a non-human primate, a canine, a feline, an bovine, a porcine, an ovine, a rat, a mouse. In some embodiments, the method further comprises inducing tolerance to the Cas protein.

In another aspect, the present disclosure provides an engineered composition for site directed base editing comprising a targeting domain and a adenosine or cytidine deaminase, wherein the deaminase has reduced immunogenicity compared to a naturally occurring deaminase.

In some embodiments, the deaminase comprises at least one T cell epitope mutation. In some embodiments, the mutation comprises an insertion, deletion, or substitution. In some embodiments, the composition further comprises a mutation of the targeting domain that reduces immunogenicity. In some embodiments, the targeting domain is an oligonucleotide binding domain. In some embodiments, the deaminase, or catalytic domain thereof, comprises one or more mutations that increase activity or specificity of the adenosine deaminase relative to wild type. In some embodiments, the deaminase comprises one or more mutations that changes the functionality of the deaminase relative to wild type, preferably an ability of the deaminase to deaminate cytidine. In some embodiments, the targeting domain is a CRISPR system comprising a Cas protein, or fragment thereof which retains DNA and/or RNA binding ability, and a guide molecule. In some embodiments, the CRISPR system is catalytically inactive. In some embodiments, the CRISPR system comprises an RNA-binding protein, preferably Cas13, preferably the Cas13 protein is Cas13a, Cas13b or Cas13c, preferably wherein said Cas13 comprises a Cas13 listed in any of Tables 4, 5, or 6 or is from a bacterial species listed in any of Tables 4, 5, or 6, preferably wherein said Cas13 protein comprises *Prevotella* sp.P5-125 Cas13b, Porphyromas gulae Cas13b, or *Riemerella anatipestifer* Cas13b; preferably *Prevotella* sp.P5-125 Cas13b.

In some embodiments, the guide molecule comprises a guide sequence is capable of hybridizing with a target RNA sequence comprising an Adenine to form an RNA duplex, wherein said guide sequence comprises a non-pairing Cytosine at a position corresponding to said Adenine resulting in an A-C mismatch in the RNA duplex formed. In some embodiments, the Cas13 protein is a Cas13a protein and said Cas13a comprises one or more mutations the two HEPN domains, particularly at position R474 and R1046 of Cas13a protein originating from Leptotrichia *wadei* or amino acid positions corresponding thereto of a Cas13a ortholog, or wherein said Cas13 protein is a Cas13b protein and said Cas13b comprises a mutation in one or more of positions R116, H121, R1177, H1182, preferably R116A, H121A, R1177A, H1182A of Cas13b protein originating from Bergeyella zoohelcum ATCC 43767 or amino acid positions corresponding thereto of a Cas13b ortholog, or wherein said Cas13 protein is a Cas13b protein and said Cas13b comprises a mutation in one or more of positions R128, H133, R1053, H1058, preferably H133 and H1058, preferably H133A and H1058A, of a Cas13b protein originating from *Prevotella* sp. P5-125 or amino acid positions corresponding thereto of a Cas13b orthologs. In some embodiments, the Cas13, preferably Cas13b, is truncated, preferably C-terminally truncated, preferably wherein said Cas13 is a truncated functional variant of the corresponding wild type Cas13, optionally wherein said truncated Cas13b is encoded by nt 1-984 of *Prevotella* sp.P5-125 Cas13b or the corresponding nt of a Cas13b orthologue or homologue. In some embodiments, the guide molecule comprises a guide sequence is capable of hybridizing with a target RNA sequence comprising a Cytidine to be edited to form an RNA duplex. In some embodiments, the guide sequence has a length of about 20-53 nt, preferably 25-53 nt, more preferably 29-53 nt or 40-50 nt capable of forming said RNA duplex with said target sequence, and/or wherein the distance between said non-pairing C and the 5' end of said guide sequence is 20-30 nucleotides. In some embodiments, the guide sequence comprises more than one mismatch corresponding to different adenosine sites in the target RNA sequence or wherein two guide molecules are used, each comprising a mismatch corresponding to a different adenosine sites in the target RNA sequence. In some embodiments, the cytidine deaminase protein or catalytic domain thereof is fused to a N- or C-terminus of said oligonucleotide binding protein, optionally by a linker, preferably where said linker is (GGGGS) 3-11 (SEQ ID NO: 198, 212, 213, 199, 214, 215, 200, 216, 217), GSG5 (SEQ ID NO: 258), or LEP-GEKPYKCPECGKSFSQSGALTRHQRTHTR (SEQ ID NO:253), or wherein said linker is an XTEN, linker. In some embodiments, the cytidine deaminase protein or catalytic domain thereof is inserted into an internal loop of said dead Cas13 protein. In some embodiments, the cytidine deaminase protein or catalytic domain thereof is linked to an adaptor protein and said guide molecule or said dead Cas13 protein comprises an aptamer sequence capable of binding to said adaptor protein, preferably wherein said adaptor sequence is selected from MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In some embodiments, the targeting domain and optionally said cytidine deaminase or catalytic domain thereof comprise one or more heterologous nuclear export signal(s) (NES(s)) or nuclear localization signal(s) (NLS(s)), preferably an HIV Rev NES or MAPK NES, preferably C-terminal.

In some embodiments, the Cas13 protein is truncated at a C terminus, an N terminus, or both. In some embodiments, the Cas13 is truncated by at least 20, at least 40, at least 60, at least 80, at least 100, at least 120, at least 140, at least 160, at least 180, at least 200, at least 220, at least 240, at least 260, or at least 300 amino acids on the C terminus. In some embodiments, the Cas13 is truncated by at least 20, at least 40, at least 60, at least 80, at least 100, at least 120, at least 140, at least 160, at least 180, at least 200, at least 220, at least 240, at least 260, or at least 300 amino acids on the N terminus. In some embodiments, the truncated form of the Cas13 effector protein has been truncated at C-terminal Δ984-1090, C-terminal Δ1026-1090, C-terminal Δ1053-1090, C-terminal Δ934-1090, C-terminal Δ884-1090, C-terminal Δ834-1090, C-terminal Δ784-1090, or C-terminal Δ734-1090, wherein amino acid positions of the truncations correspond to amino acid positions of *Prevotella* sp. P5-125 Cas13b protein. In some embodiments, the truncated form of the Cas13 effector protein has been truncated at C-terminal Δ795-1095, wherein amino acid positions of the truncation correspond to amino acid positions of *Riemerella anatipestifer* Cas13b protein. In some embodiments, the truncated form of the Cas13 effector protein has been truncated at C-terminal Δ 875-1175, C-terminal Δ 895-1175, C-terminal Δ 915-1175, C-terminal Δ 935-1175, C-terminal Δ 955-1175, C-terminal Δ 975-1175, C-terminal Δ 995-1175, C-terminal Δ 1015-1175, C-terminal Δ 1035-1175, C-terminal Δ 1055-1175, C-terminal Δ 1075-1175, C-terminal Δ 1095-1175, C-terminal Δ 1115-1175, C-terminal Δ 1135-1175, C-terminal Δ 1155-1175, wherein amino acid positions correspond to amino acid positions of *Porphyromonas gulae* Cas13b protein. In some embodiments, the truncated form of the Cas13 effector protein has been truncated at N-terminal Δ1-125, N-terminal Δ 1-88, or N-terminal Δ 1-72, wherein amino acid positions of the truncations correspond to amino acid positions of *Prevotella* sp. P5-125 Cas13b protein. In some embodiments, the adenosine deaminase is modified to convert activity to a cytidine deaminase. In some embodiments, the adenosine deaminase is modified by one or more mutations at one or more positions selected from E396, C451, V351, R455, T375, K376, S486, Q488, R510, K594, R348, G593, S397, H443, L444, Y445, F442, E438, T448, A353, V355, T339, P539, V525 and I520. In some embodiments, the adenosine deaminase is mutated at one or more positions selected from E488, V351, S486, T375, S370, P462, and N597. In some embodiments, the adenosine deaminase comprises one or more mutations selected from E488Q, V351G, S486A, T375S, S370C, P462A, and N597I.

In some embodiments, the adenosine deaminase protein or catalytic domain thereof is a human, cephalopod, or *Drosophila* adenosine deaminase protein or catalytic domain thereof. In some embodiments, the adenosine deaminase protein or catalytic domain thereof has been modified to comprise a mutation at glutamic acid488 of the hADAR2-D amino acid sequence, or a corresponding position in a homologous ADAR protein. In some embodiments, the glutamic acid residue at position 488 or a corresponding position in a homologous ADAR protein is replaced by a glutamine residue (E488Q). In some embodiments, the adenosine deaminase protein or catalytic domain thereof is a mutated hADAR2d comprising mutation E488Q or a mutated hADAR1d comprising mutation E1008Q. In some embodiments, the targeting domain is a catalytically inactive Cas13 protein, or a nucleotide sequence encoding said catalytically inactive Cas13 protein. In some embodiments, the catalytically inactive Cas13 protein is catalytically inactive Cas13a, catalytically inactive Cas13b, or catalytically inactive Cas13c. In some embodiments, the catalytically inactive Cas13 protein is obtained from a Cas13 nuclease derived from a bacterial species selected from the group consisting of the bacterial species listed in any of Tables 4, 5, or 6.

These and other aspects, objects, features, and advantages of the example embodiments will become apparent to those having ordinary skill in the art upon consideration of the following detailed description of illustrated example embodiments.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{t}_{h}$ edition (2012) (Green and Sambrook);

Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, 2$^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, 2$^{nd}$ edition (2011).

As used herein, the singular forms "a" "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humor, vitreous humor, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The term "exemplary" is used herein to mean serving as an example, instance, or illustration. Any aspect or design described herein as "exemplary" is not necessarily to be construed as preferred or advantageous over other aspects or designs. Rather, use of the word exemplary is intended to present concepts in a concrete fashion.

The terms "Cas enzyme", "CRISPR enzyme", "CRISPR protein", "Cas protein", "CRISPR-Cas enzyme", "CRISPR-Cas protein", "CRISPR-Cas effector protein", "CRISPR-Cas effector", "CRISPR effector protein", and "Cas effector protein" are generally used interchangeably and at all points of reference herein refer by analogy to Cas proteins further described in this application.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

OVERVIEW

The present disclosure provides engineered or non-naturally occurring Cas proteins with reduced immunogenicity compared to wildtype counterpart, and methods of screening and use thereof. It is provided herein that Cas proteins can be deimmunized without significantly altering activity, including but not limited to nucleic acid binding, complex formation, target binding, and target cleavage. In particular, analyses of Cas proteins are provided to identify MHC I and MHC II binding regions. Mutations can be made in various regions of the Cas proteins to reduce immunogenicity of the protein. The mutations may be combined in the same protein to further reduce immunogenicity.

In one aspect, embodiments disclosed herein are directed to engineered Cas proteins that comprise at least one modification (compared to an unmodified Cas protein) that reduces immunogenicity of the engineered proteins, complexes, and systems. The modification may enhance binding of the of the CRISPR complex to the binding site and/or alters editing preference as compared to a wild type counterpart. In certain example embodiments, the Cas proteins is class 2 Cas proteins, such as Type II, Type V, or Type VI Cas proteins.

In another aspect, the present disclosure provides methods of reducing immunogenicity of a Cas protein. The method may comprise introducing one or more modifications in the Cas protein. The modification may mutate one or more epitopes of immune cells (e.g., T cells).

In another aspect, embodiments disclosed herein are directed to viral vectors for delivery of the engineered Cas proteins. In certain example embodiments, the vectors are designed so as to allow packaging of the Cas protein within a single vector. There is also an increased interest in the design of compact promoters for packing and thus expressing larger transgenes for targeted delivery and tissue-specificity. Thus, in another aspect, certain embodiments disclosed herein are directed to delivery vectors, constructs, and methods of delivering larger genes for systemic delivery.

In another aspect, the present invention relates to methods for developing or designing CRISPR-Cas systems. In an aspect, the present invention relates to methods for developing or designing optimized CRISPR-Cas systems a wide range of applications including, but not limited to, therapeutic development, bioproduction, and plant and agricultural applications. The present invention in particular relates to methods for improving CRISPR-Cas systems, such as CRISPR-Cas system based therapy or therapeutics. Key characteristics of successful CRISPR-Cas systems, such as CRISPR-Cas system based therapy or therapeutics involve high specificity, high efficacy, and high safety. High specificity and high safety can be achieved among others by reduction of off-target effects. Improved specificity and efficacy likewise may be used to improve applications in plants and bioproduction.

The methods herein involve optimization of selected parameters or variables associated with the CRISPR-Cas system and/or its functionality, as described herein further elsewhere. Optimization of the CRISPR-Cas system in the methods as described herein may depend on the target(s), such as the therapeutic target or therapeutic targets, the mode or type of CRISPR-Cas system modulation, such as CRISPR-Cas system based therapeutic target(s) modulation, modification, or manipulation, as well as the delivery of the CRISPR-Cas system components. One or more targets may be selected, depending on the genotypic and/or phenotypic outcome. For instance, one or more therapeutic targets may be selected, depending on (genetic) disease etiology or the desired therapeutic outcome. The (therapeutic) target(s) may be a single gene, locus, or other genomic site, or may be multiple genes, loci or other genomic sites. As is known in the art, a single gene, locus, or other genomic site may be targeted more than once, such as by use of multiple gRNAs.

CRISPR-Cas system activities may involve target disruption, such as target mutation, such as leading to gene knockout, replacement of particular target sites, such as leading to target correction, removal of particular target sites, such as leading to target deletion, modulation of target site functionality, such as target site activity or accessibility, leading for instance to (transcriptional and/or epigenetic) gene or genomic region activation or gene or genomic region silencing. The skilled person will understand that modulation of target site functionality may involve Cas protein mutation (such as for instance generation of a catalytically inactive Cas protein) and/or functionalization (such as for instance fusion of the Cas protein with a heterologous functional domain, such as a transcriptional activator or repressor), as described herein elsewhere.

Reduction of Immunogenicity

The present disclosure provides methods of reducing immunogenicity and engineered proteins (e.g., Cas proteins) with reduced immunogenicity. In general, immunogenicity of a protein may be reduced by modifying one or more epitopes of immune cells on the protein. The epitopes may be T cell epitopes. As used herein, the term "deimmunized" or "reducing immunogenicity", when used in reference to CRISPR, relates to Cas proteins (e.g., Cas9, Cas12a, Cas12b, Cas13, orthologs, mutants, truncations and other variants), wherein the specific removal and/or modification of highly immunogenic regions or residues has occurred. Removal means removal of the immunogenic epitope, which can occur by deletion, insertion, or substitution of amino acids and/or changes in glycosylation. Exemplary approaches of deimmunizing or reducing immunogenicity has been employed for the removal of T-cell epitopes from therapeutic molecules including antibodies (See, e.g., WO 98/52976 or WO 00/343170).

Epitopes and Methods of Identification

T Cell Epitopes

T cell epitopes include short amino acid sequences that are recognized by T-cells in the context of MHC class I and/or class II molecules. The immunogenicity of a specific T cell epitope is a function of a combination of factors, including, for example, intracellular antigen processing, peptide binding to MHC molecules, and recognition of the peptide complexed with the MHC by the relevant T cell receptor. Because MHC-peptide binding is a key step in determining the repertoire of peptides that will be presented to the T cell, identification of peptides (also referred to as HLA ligands) that bind to MHC molecules can be used to identify candidate T cell epitopes.

As noted above, thousands of MHC peptide ligands have been identified. The peptide sequence can be displayed as a sequence logo, a useful tool for visual display of conservation and variability in multiple sequence alignments. Useful sequence logo applications for T cell epitopes as well as exemplary HLA-A peptide motifs are described in Olson, L. R., et al., "Blocklogo: visualization of peptide and sequence motif conservation." J, Immunol. Methods 2013 Dec. 31; 400-401:37-44. Hierarchical clustering of HLA-A, HLA-B, and HLA-C alleles based on their binding specificity to particular motifs is shown in Gfeller, D. et al., "Predicting Antigen Presentation—What Could We Learn From a Million Peptides?" Front Immunol. 2018; 9: 1716. Exemplary MHC Class II peptide ligands are described, for example, in Barra C. I. et al., "Footprints of antigen processing boost MHC class II natural ligand predictions." Genome Med. 2018 Nov. 16; 10(1):84.

Epitopes that bind to MHC molecules may be identified by two general approaches: in vitro binding data or mass spectrometry (MS) measurements of eluted MHC binding peptides. The in vitro approach involves testing chemically synthesized peptides in biochemical or cell-based assays for specific binding to MHC molecules. Immunogenic T cell epitopes in a CRISPR polypeptide or fragment thereof can be identified using such in vitro assays. Exemplary methods for identifying peptide ligands that bind HLA Class I molecules include, without limitation, refolding assays using conformational pan HLA-I antibodies to test whether the HLA-I complex is properly folded in the presence of a peptide; peptide-rescuing assays based on a photo-cleavable peptide that is stripped by UV radiation in the presence of another peptide; competitive binding assays with radiolabeled to determine relative affinity, that is; the IC50; dissociation assays based on radiolabeled $\beta$2m to probe the stability of peptide-HLA-I complexes; and surface plasmon resonance techniques to measure actual Kd values. Exemplary methods for identifying peptide ligands that bind to HLA Class II include high throughput screening with peptide microarrays, phage display, or yeast display. Additional assays include peptide threading, ELISPOT assays, and functional assays, for example, analysis of cytokine expression patterns.

The MS approach relies on immunoaffinity purification of HLA complexes from cell lysates followed by extraction of the bound peptides. Immunogenic T cell epitopes in a CRISPR polypeptide or fragment thereof can be identified using MS analysis. The extracted peptides are separated by HPLC and analyzed by mass spectrometry (MS). The resulting spectra are compared with in silico generated spectra of peptides from protein sequence databases with MS search tools. The MS approach provides a comprehensive picture of the entire repertoire of naturally occurring HLA ligands. An exemplary MS profiling method is described in Abelin, J. G. et al., "Mass Spectrometry Profiling of HLA-Associated Peptidomes in Mono-allelic Cells Enables More Accurate Epitope Prediction." Immunity. 2017 Feb. 21; 46(2):315-326.

Immunogenic T cell epitopes in a CRISPR polypeptide or a fragment thereof can be identified using an epitope prediction tool. See, for example, Sanchez-Trincado et al., "Fundamentals and Methods for T- and B-Cell Epitope Prediction," J. Immunol. Res. 2017; 2017: 2680160. Published online 2017 Dec. 28. Such methods fall into two general categories: structure based methods that rely on modeling the peptide-MHC structure and data-driven methods that rely on peptide sequences that are known to bind to MHC molecules. Sanchez-Trincado et al., list epitope prediction tools that rely on a variety of methods including structure-based tools (SB); sequence motifs (SM); motif matrices (MM); quantitative structure-activity relationship models (QSAR); quantitative affinity matrices (QAM); support vector machines (SVM); artificial neural networks (ANN) and combinations of these methods.

Epitope prediction tools that are useful for predicting MHC Class I epitopes in CRISPR polypeptide or fragment thereof include, for example MAPP (See e.g., Hakenberg J. et al., "MAPPP: MHC class I antigenic peptide processing prediction." Applied Bioinformatics. 2003; 2(3):155-158.); PEPVAC (See e.g., Reche et al., space "PEPVAC: a web server for multi-epitope vaccine development based on the prediction of supertypic MHC ligands." Nucleic Acids Research. 2005; 33 (Supplement 2):W138-W142); EPISOPT (See e.g., Molero-Abraham M. et al., "Selection of conserved epitopes from hepatitis C virus for pan-populational stimulation of T-cell responses." Clinical and Developmental Immunology. 2013;2013: 10); BIMAS (See e.g., Parker K. C. et al., "Scheme for ranking potential HLA-A2 binding peptides based on independent binding of individual peptide side-chains." The Journal of Immunology. 1994; 152 (1):163-175; Propred-1 (See e.g., Singh H. et al., "ProPred1: prediction of promiscuous MHC class-I binding sites." Bioinformatics. 2003; 19(8):1009-1014.); EpiJen (See e.g., Doytchinova I. A. et al., "EpiJen: a server for multistep T cell epitope prediction." BMC Bioinformatics. 2006;7(1):p. 131); IEDB-MHCI (See e.g., Zhang Q. et al., "Immune epitope database analysis resource (IEDB-AR)" Nucleic Acids Research. 2008;36(Web Server issue):W513-W518); NetMHC (See e.g., Nielsen M.et al., "Reliable prediction of T-cell epitopes using neural networks with novel sequence representations." Protein Science. 2003; 12(5):1007-1017); NetMHCpan (See e.g., Nielsen M.et al., "NetMHCpan, a method for quantitative predictions of peptide binding to any HLA-A and -B locus protein of known sequence." PLoS One. 2007; 2(8, article e796)); nHLApred (See e.g., Bhasin M.et al., "A hybrid approach for predicting promiscuous MHC class I restricted T cell epitopes." Journal of Biosciences. 2007; 32(1):31-42); NetCTL (See e.g., Larsen M. V. et al., "An integrative approach to CTL epitope prediction: a combined algorithm integrating MHC class I binding, TAP transport efficiency, and proteasomal cleavage predictions." European Journal of Immunology. 2005; 35(8):2295-2303); and WAPP (See e.g., Donnes P.et al.,"Integrated modeling of the major events in the MHC class I antigen processing pathway." Protein Science. 2005; 14 (8):2132-2140).

Epitope prediction tools that are useful for predicting MHC Class II epitopes in a CRISPR polypeptide or fragment thereof include, for example, EpiDOCK (See e.g., Atanasova M. et al., "EpiDOCK: a molecular docking-based tool for MHC class II binding prediction." Protein Engineering, Design and Selection. 2013; 26(10):631-634); PREDIVAC (See e.g., Oyarzun P. et al., "PREDIVAC: CD4+ T-cell epitope prediction for vaccine design that covers 95% of HLA class II DR protein diversity." BMC Bioinformatics. 2013; 14(1):p. 52.); EpiTOP (See e.g., Dimitrov Let al., "EpiTOP-a proteochemometric tool for MHC class II binding prediction." Bioinformatics. 2010; 26(16): 2066-2068); TEPITOPE (See e.g., Sturniolo T., et al. "Generation of tissue-specific and promiscuous HLA ligand databases using DNA microarrays and virtual HLA class II matrices." Nature Biotechnology. 1999; 17(6):555-561); Proped (See e.g., Singh H. et al.,"ProPred: prediction of HLA-DR binding sites." Bioinformatics. 2001; 17(12): 1236-1237); IEDB-MHCII (See e.g., Zhang Q. et al., "Immune epitope database analysis resource (IEDB-AR)" Nucleic Acids Research. 2008;36(Web Server issue):W513-W518); IL4 pred (See e.g., Dhanda S. K. et al., "Prediction of IL4 inducing peptides." Clinical and Developmental Immunology. 2013; 2013:9); MHC2PRED (See e.g., Bhasin M. et al.,"SVM based method for predicting HLA-DRB1*0401 binding peptides in an antigen sequence." Bioinformatics. 2004; 20(3):421-423); NetMHCII (See e.g., Nielsen M. et al., "Prediction of MHC class II binding affinity using SMM-align, a novel stabilization matrix alignment method." BMC Bioinformatics. 2007;8(1):p. 238); and NetMHCIIpan (See e.g., Nielsen M., et al. "Quantitative predictions of peptide binding to any HLA-DR molecule of known sequence: NetMHCIIpan." PLoS Computational Biology. 2008;4(7)).

Epitope prediction tools that are useful for predicting either MHC Class I or MHC Class II epitopes in a CRISPR polypeptide or fragment thereof include, for example, MotifScan (See e.g., www.hiv.lanl.gov/content/immunology/motif_scan/motif_scan.); Rankpep (See e.g., Reche P. A., et al., "Enhancement to the RANKPEP resource for the prediction of peptide binding to MHC molecules using profiles." Immunogenetics. 2004; 56(6):405-419.); SYFPEITHI (See e.g., Rammensee H. G. et al., "SYFPEITHI: database for MHC ligands and peptide motifs." Immunogenetics. 1999;50(3-4):213-219); Vaxign (See e.g., He Y. et al., "Vaxign: the first web-based vaccine design program for reverse vaccinology and applications for vaccine development." Journal of Biomedicine and Biotechnology. 2010; 2010:15); MHCPred (See e.g., Guan P. et al., "MHCPred: a server for quantitative prediction of peptide-MHC binding." Nucleic Acids Research. 2003; 31(13):3621-3624); MULTIPRED2 (See e.g., Zhang G. L. Et al., "MULTIPRED2: a computational system for large-scale identification of peptides predicted to bind to HLA supertypes and alleles." Journal of Immunological Methods. 2011;374(1-2):53-61);

SVMHC (See e.g., Donnes P. et al., "Prediction of MHC class I binding peptides, using SVMHC." BMCBioinformatics. 2002;3(1):p. 25); and SVRMHC (See e.g., Liu W. et al., "Quantitative prediction of mouse class I MHC peptide binding affinity using support vector machine regression (SVR) models." BMC Bioinformatics. 2006;7(1):p. 182).

Alternatively, or in addition, MHC Class I binding specificity can be analyzed using allele-specific predictors, either by using simple sequence motifs e.g., xLxxxxxx(L/V) for HLA-A02:01) or Position Weight Matrices (PWM) or with machine learning frameworks such as neural networks, hidden Markov Models, support vector machines, or convolutional neural networks. The machine learning models have the capacity to consider potential correlations between different positions within HLA-I ligands. (See e.g., Gfeller, D. et al., "Predicting Antigen Presentation-What Could We Learn From a Million Peptides?" Front Immunol. 2018; 9: 1716.)

Experimental ligands/peptides are available for only about 100 HLA-I alleles, so that the ligand specific predictors described above are useful only for a small fraction of the more than 12,000 HLA I alleles that have been identified to date. To identify additional ligands/peptides, "pan-allele predictors" can be used. For these methods, the input of the algorithm includes both the sequence of the ligand and the sequence of the HLA-I allele (or of its binding site). These algorithms can capture correlations between amino acids in the HLA-I-binding site and in the ligand. An exemplary pan-specific algorithm is the NetMHCpan tool. (See e.g., Jurtz V. et al., "NetMHCpan-4.0: improved peptide-MHC class I interaction predictions integrating eluted ligand and peptide binding affinity data." J. Immunol (2017) 199:3360-8.10.4049) which includes several features specific for HLA-I molecules, such as combining peptides of different lengths in the training and incorporating peptide length preferences.

Useful ligand predictors for both allele specific and pan-allele analysis are summarized in Table 1 below (adapted from Gfeller, D. et al., "Predicting Antigen Presentation-pWhat Could We Learn From a Million Peptides?" Front Immunol. 2018; 9: 1716; Sanchez-Trincado et al., "Fundamentals and Methods for T- and B-Cell Epitope Prediction," J. Immunol. Res. 2017; 2017: 2680160.)

MHC Class-II binding specificity can also be analyzed with machine learning frameworks. Modeling the binding specificity of MHC Class II alleles can be more challenging than modeling of MHC Class I alleles due to a number of factors, for example: 1) MHC Class II alleles tend to be more degenerate and less specific motifs; 2) MHC Class II molecules form dimers, resulting in more diversity, particularly where both members of a dimer or polymorphic; and 3) MHC Class II molecules tend to have greater conformational flexibility, which can be difficult to predict from short peptide sequences.

Useful Allele-specific HLA-II ligand predictors can include NetMHCII (See e.g., Jensen K. K. et al., "Improved methods for predicting peptide binding affinity to MHC class II molecules." Immunology (2018) 154:394-406), Pro-Pred (See e.g., Singh H. et al., "ProPred: prediction of HLA-DR binding sites." Bioinformatics (2001) 17:1236-7.), MHCPred (See e.g., Guan P. et al., "MHCPred: a server for quantitative prediction of peptide-MHC binding." Nucleic Acids Res (2003) 31:3621-4); TEPITOPE (See e.g., Sturniolo T. et al., "Generation of tissue-specific and promiscuous HLA ligand databases using DNA microarrays and virtual HLA class II matrices." Nat Biotechnol (1999) 17:555-61.); and consensus methods (See e.g., Wang P., et al., "A systematic assessment of MHC class II peptide binding predictions and evaluation of a consensus approach." PLoS Comput Biol (2008) 4:e1000048.). Pan-specific class II predictors typically include NetMHCIIpan (See e.g., Jensen K. K. et al., "Improved methods for predicting peptide binding affinity to MHC class II molecules." Immunology (2018) 154:394-406).

Adaptive Immunity

A modified Cas protein with reduced immunogenicity may trigger lower level of a response from the adaptive immune system compared to a unmodified counterpart Cas protein. The adaptive immune system, also referred to as the acquired immune system, is a complex multicellular system that encompasses both humoral immunity, mediated by B lymphocytes, and cell-mediated immunity, mediated by T lymphocytes. The adaptive immune system can recognize and destroy invading pathogens. In addition, the adaptive immune system can acquire an immunological memory as a result of exposure to a specific pathogen, resulting in an enhanced response during subsequent encounters with that particular pathogen.

Both B and T lymphocytes are derived from hematopoietic stem cells. T lymphocytes, also referred to as T cells, mature through the thymus and are generally identified by their expression of CD3 (which is associated with the T cell receptor) and either CD4 or CD8. Multiple T cell subtypes have been described. Effector cells encompass those cells that respond to a stimulus and include T helper cells (also referred to as $T_H$ cells), cytotoxic T cells (also referred to as

TABLE 1

| Name | Training data | Output | Algorithm | Allele coverage | Access |
| --- | --- | --- | --- | --- | --- |
| NetMHC4.0 | BA | BA | NN | S | www.cbs.dtu.dk/services/NetMHC/ |
| NetMHCpan4.0 | BA + MS | R (BA) | NN | Pan | www.cbs.dtu.dk/services/NetMHCpan-4.0/ |
| NetMHCII | BA + MS | R (BA) | NN | S | www.cbs.dtu.dk/services/NetMHCII/ |
| NetMHCIIpan | BA + MS | R (BA) | NN | Pan | www.cbs.dtu.dk/services/NetMHCIIpan/ |
| MixMHCpred | MS | R | PWM | S | github.com/GfellerLab/MixMHCpred |
| MHCflurry | BA | BA | NN | S | github.com/openvax/mhcflurry |
| PickPocket | BA | BA | PWM | Pan | www.cbs.dtu.dk/services/PickPocket/ |
| NetMHCstabpan | BS | BS | NN | Pan | www.cbs.dtu.dk/services/NetMHCstabpan/ |
| NetMHCstab | BS | BS | NN | S | www.cbs.dtu.dk/services/NetMHCstab/ |
| NetMHCcons | BA | BA | C | S | www.cbs.dtu.dk/services/NetMHCcons/ |
| IEDB consensus | BA | R | C | S | ools.iedb.org/mhci/ |
| SMMPMBEC | BA | R | PWM | S | github.com/ykimbiology/smmpmbec |
| MHCnuggets | BA | BA | NN | S | github.com/KarchinLab/mhcnuggets-2.0 |

(Abbreviations: BA, binding affinity; BS, binding stability; MS, HLA peptidomics data; R, ranking; NN, Neural network (including deep networks); PWM, position weight matrices; C, consensus; S, allele specific; Pan, pan-class I.)

T$_c$ cells, CTLs, and killer T cells), memory T cells; regulatory T cells (also referred to as T$_{Reg}$); natural killer T cells (NKT), mucosal invariant T cells (MAIT) and γδ T cells. CD8-expressing (or CD8+) T cells are principally involved with direct cell killing, or cytotoxicity. CD4+ T cells are primarily regulatory cells which stimulate and suppress immune responses as needed. T cells within the subtypes can also undergo further differentiation. For example, T$_h$ cells can differentiate into including TH$_1$, TH$_2$, TH$_3$, TH$_{17}$, TH$_9$, or T$_{FH}$ cells that each secrete different cytokines. Memory T cells can further differentiate into central memory T cells (T$_{CM}$), effector memory T cells (T$_{EM}$ and TEM$_{RA}$) tissue resident memory T cells (T$_{RM}$) and virtual memory T cells B lymphocytes also referred to as B cells, are characterized by their expression of CD19 or CD20, among other surface markers. B cells are responsible for antibody production. B cells are also effective antigen presenting cells.

Both T cells and B cells specifically bind to epitopes, also referred to as antigenic determinants. Epitopes generally are parts of larger molecules such as polypeptides, nucleic acids, or glycolipids.

MHC

The modification of the Cas proteins may result in reduced binding and/or recognition of the Cas proteins by MHC. T cell recognition of antigens occurs via the T cell receptor (TCR), a specific receptor expressed on the surface of T cells. The T cell receptor binds to antigens when they are complexed with the major histocompatibility complex (MHC), a polypeptide assembly present on the surface of antigen presenting cells. In humans, the MHC is also referred to as human leukocyte antigen (HLA). In mice, the MHC is also referred to as the H-2 complex or H-2. The MHC encompasses a large multi gene family, which in humans is encoded by 21 genes, that is divided into three subgroups: Class I, Class II, and Class III. The MHC Class I and II function in antigen presentation. These two classes differ structurally and functionally.

Class I. Class I polypeptides are primarily encoded by three genes, HLA-A, HLA-B, and HLA-C. These genes, which are expressed in nearly all human nucleated cells, are highly polymorphic and over 12,000 distinct alleles have been described. Specialized cell types can also express HLA-E, HLA-F, and HLA-G. Humans generally express different combinations of HLA-I alleles and so can express up to six different HLA-I polypeptides. The MHC Class I polypeptide is made up of an alpha chain comprising three domains (α1, α2, and α3). The MHC class I alpha chain functions in a noncovalent complex with a β2 microglobulin (β2m) polypeptide.

Functionally, the MHC Class I pathway processes and presents intracellular proteins, for example intracellular pathogens such as viruses and bacteria, for example *Mycoplasma* and *Rickettsia*. The intracellular proteins are degraded into peptides in the proteosome and the peptides are transported to the endoplasmic reticulum (ER) by the transporter associated with antigen processing (TAP), a protein complex that is a member of the ATP binding cassette transporter family. In the ER, the peptides bind to MHC Class I molecules that have been complexed with β2 microglobulin (β2m). The peptide-MHC Class I complexes are trafficked to the cell surface where they can be recognized by CD8 T cells.

Class II. The MHC Class II polypeptides are encoded by HLA-DP (the α chain encoded by the HLA-DPA1 locus: the β chain encoded by the HLA-DPB1 locus); HDLA-DQ (the α chain encoded by the HLA-DQA1 locus; the β chain encoded by the HLA-DQB1 locus); HLA-DR (the α chain encoded by the HLA-DRA locus; the four β chains encoded by the HLA-DRB1, HLA-DRB3, HLA-DRB4, and HLA-DRB5 loci). Other MHC class II genes include HLA-DM, which encodes a polypeptide that catalyzes the loading of peptides onto HLA-II molecules, and HLA-DO, which encodes a polypeptide that catalyzes peptide exchange. The MHC Class II genes are also highly polymorphic. MHC Class II genes are typically expressed by professional antigen-presenting cells (APCs), macrophages, B cells, and dendritic cells (DCs), but can be conditionally expressed by all cell types. The MHC class II complex includes an α chain and a β chain, for example, HLA-DRA/HLA-DRB 1, 3, 4, 5; HLA-DPA1/HLA-DPB1; and HLA-DPA1/HLA-DPB1.

In contrast to the MHC Class I pathway, the MHC Class II pathway processes and presents extracellular antigens, for example, extracellular pathogens such as bacteria, viruses, and fungi. Extracellular antigens are taken into the cell by phagocytosis, where they are digested into peptides in lysosomes. Endogenous polypeptides can also be presented on HLA-II molecules if taken up by autophagy. The resulting peptide fragments are transported to endosomes where they bind to the HLA II receptor before transport to the cell surface.

MHC binding. The MHC Class I and MHC Class II complexes have similar structures. Both have an antigen-binding groove composed of two alpha helices above a surface composed of eight anti-parallel beta strands. However, the structures of the binding grooves differ in ways that are relevant to peptide binding, also referred to as ligand binding or peptide ligand binding. The peptide binding groove of the MHC Class I complex is formed from a single alpha chain and so can only accommodate short peptides ranging from about 9 to about 11 amino acids. The N and the C-terminal ends of such peptides are hydrogen bonded to conserved residues of the MHC Class I molecule. The MHC Class I peptide binding groove also includes deep binding pockets having specific physicochemical preferences. Peptides of different sizes that bind to the same MHC Class I molecule can use different binding pockets. Generally, methods of predicting peptide MHC Class I binding rely on a fixed peptide length.

The peptide binding groove of the MHC Class II molecule is "open." The binding groove accommodates a core peptide of 9 residues. But, the open configuration means that the N- and C-terminal ends of the peptide can extend beyond the binding groove, so that the MHC Class II bound peptides can vary in length and range from about nine to about 22 amino acids. The MHC Class II binding pocket is also shallower and less constrained, so that prediction can be less accurate than that obtained for MHC Class I.

The exact number of HLA alleles has yet to be determined. As of October 2018, the number of HLA Class I alleles was reported to be over 13,000, and the number of HLA Class II alleles was reported to be over 5000, the number of theoretical possible combinations of HLA Class II alleles is estimated to be upwards of 50,000. (See e.g., the IMGT-HLA database www.ebi.ac.uk/ipd/imgt/hla/). The HLA allelic variants bind to different sets of peptides. Thousands of peptide ligands have been described for the most frequent alleles, although many of the less frequent alleles remain unanalyzed.

Other Exemplary Deimmunization Strategies

Methods that have been developed for the selection of candidate protein analogs with reduced HLA binding and immunogenicity can be used to identify candidate CRISPR polypeptide epitopes having reduced immunogenicity. (See e.g., Dhanda et al., "Development of a strategy and computational application to select candidate protein analogues with reduced HLA binding and immunogenicity." Immunology (2018) 153:118-132.) Dhanda et al., describe a three-step strategy for reducing immunogenicity of HLA-II epitopes. The method relied on the publicly available Immune Epitope Database (IEDB tools.iedb.org/deimmunization/). In the first step, immunogenic peptides were predicted. In the second step, all possible variants of the immunogenic peptides having decreased binding affinities compared to the wild type sequences were identified. In the third step, all the sequences with predicted reduced binding were ranked according to their predicted effect on neighboring peptides. The third step reduces the likelihood that sequence alterations that decrease HLA binding capacity will not unintentionally create new epitopes in neighboring sequences.

Another platform that could be used to identify candidate CRISPR polypeptide epitopes having reduced immunogenicity is the EpiSweep suite of protein design algorithms. (See e.g., Choi, Y. et al., "EpiSweep: Computationally-driven Reengineering of Therapeutic Proteins to Reduce immunogenicity while Maintaining Function." Methods Mol Biol. 2017; 1529: 375-398.

Antigen Processing and Presentation

Antigen processing and presentation can also be integrated into methods to predict MHC epitopes. Cleavage site prediction tools and predictions of TAP transport can increase the predictability of peptide-MHC binding. See, for example, Sanchez-Trincado et al., "Fundamentals and Methods for T- and B-Cell Epitope Prediction," J. Immunol. Res. 2017; 2017: 2680160. Published online 2017 Dec. 28 and Gfeller, D. et al., "Predicting Antigen Presentation-What Could We Learn From a Million Peptides?" Front Immunol. 2018; 9: 1716.

Validation of Candidate T Cell Epitopes

Regardless of the method used to identify candidate T cell epitopes, such epitopes can be validated experimentally using in vitro or cell-based assays. A useful approach is described in Dhanda et al., "Development of a strategy and computational application to select candidate protein analogues with reduced HLA binding and immunogenicity." Immunology (2018) 153:118-132.) Selected peptides can be tested for immunogenicity with human peripheral blood mononuclear cells (PBMCs) using a two week in vitro restimulation protocol followed by ELISPOT assays to measure the number of cells secreting interferon-7 or IL-5 in response to stimulation with the specific peptide.

B Cell Epitopes

In some embodiments, a CRISPR polypeptide amino acid sequence can be analyzed to identify candidate B cell epitopes. B cell epitopes are short segments of about 5-10 amino acids in length. B cell epitopes can be potentially found on any solvent expose region of a polypeptide. A B cell epitope can be a linear epitope, also referred to a continuous epitope, comprising sequential amino acid residues. Alternatively, a B cell epitope can be a conformational epitope, also referred to as a discontinuous epitope, made up of solvent-exposed amino acids that are not always sequential, but are in close proximity in the three-dimensional confirmation of polypeptide. Most B cell epitopes are conformational and it is these conformational epitopes that are most relevant to strategies relating to reduction of immunogenicity.

B cell epitopes can be identified using a variety of experimental methods encompassing both structural and functional methods, including for example, x-ray crystallography, screening of antigen derived proteolytic fragments are peptides for antibody binding, and testing antigen-antibody reactivity of mutants. Computational methods of predicting B cell epitopes have also been described. Representative computational methods B cell epitope prediction have been described in Sanchez-Trincado et al., "Fundamentals and Methods for T- and B-Cell Epitope Prediction," J. Immunol. Res. 2017; 2017: 2680160. Published online 2017 Dec. 28.

T Cell Epitope Removal

Useful procedures for identification of T cell epitopes generally provide a measure of binding strength. Binding can be described, for example in terms of affinity or percentile ranking, and some algorithms may assign subjective labels such as "weak binding" and "strong binding" based on a selectable threshold number. In certain embodiments, predicted affinity may be ranked, for example compared to a set of random natural peptides. In certain embodiments, an epitope is selected for removal if its ranks in the top 0.1%, 0.2%, or 0.5%, or 1% as compared to the set of random peptides. In certain embodiments, the rankings are used as threshold values for strong binding peptides or weak binding peptides. For example, a threshold for strong binding can be 0.2%, 0.5%, or 1%, while a threshold for weak binding can be 1% or 2% or 5%. In certain embodiments, T cell epitopes in the top 10% or in the top 5% or in the top 2% are candidates for removal. In certain embodiments, T cell epitopes that are candidates bind to MHC or are calculated to bind to MHC with high affinities. In certain embodiments, affinity measures provide a cut off to distinguish binders from non-binders or from weak binders. Exemplary cutoffs for strong binders are 2 nM, 3 nM, 4 nM, 5 nM, 10 nM, 50 nM, or 100 nM. Exemplary cutoffs for weak binders are 50 nM, 100 nM, 200 nM, or 500 nM. In certain embodiments, it will be determined to remove the top 2% or the top 5% or the top 10% of peptides.

Deimmunization involves mutation of residues that are predicted, or otherwise determined to contribute to MHC binding. Individual amino acids or combinations of amino acids can be varied, by insertion, deletion, or substitution. Random selection of mutations including substitutions, insertions, or deletions, can be acceptable at some locations but at others can lead to disruption of proper folding and function. One approach is to incorporate point mutations found in sequences similar to the peptide to be mutated. Another approach is to interchange adjacent amino acids, which can have a large impact on MHC binding relative to changes in folding or function.

Generally, deimmunization allows for maintenance of function as only one or a few mutations will effectively reduce binding of MHC-peptide binding. Preserving function means a function is maintained at 50%, 75%, 90% or greater and may be increased compared to the unmutated CRISPR protein.

Additional Exemplary Deimmunization Approaches

In some embodiments, CD4+ T cell responses to the Cas proteins may be measured by one or more assays. In some examples, the assays are performed using cultures of peripheral blood mononuclear cells (PBMCs), e.g., from 50 individual donors, with a distribution of HLA-DR allotypes (e.g., coverage and frequency) representing the human population of interest. T cell proliferation and IL-2 secretion, both markers of T cell activation, may be measured using 3H-thymidine incorporation and ELISpot, respectively. In some cases, strong correlation between these markers allows the detection of CD4+ effector T cell activation and discriminates between T cell effector and regulatory responses.

In some cases, dendritic cells (DCs) from the PBMCs are used. The DCs may be differentiated in vitro to an immature DC phenotype. These cells may then be loaded with the test protein or formulation before inducing further differentiation to a mature DC phenotype. Once matured, the cells may be incubated with autologous CD4+ T cells before measuring T cell proliferation and IL-2 secretion, both markers of T cell activation, using 3H-thymidine incorporation and ELISpot, respectively. In some cases, prescreen tests using a small numbers of donors can be performed to evaluate if there is direct modulation of T cell activation prior to choosing a time course.

In some embodiments, CD4+ T cell epitopes within the Cas protein sequences may be mapped to design deimmunized variants with a lower risk of immunogenicity. The location, number and magnitude of T cell epitopes in the Cas proteins may be determined. The information can be used to aid deimmunization and contributes to the reduction in risk of clinical immunogenicity.

In some exemplary CD4+ T cell epitope mapping assays, 15mer peptides with a 12 amino acid overlap are synthesized spanning the test sample sequence. Individual peptides may then be tested against CD8+ T cell-depleted PBMCs which contain APCs and CD4+ T cells at physiological ratios from 50 donors with >80% DRB1 allotypic coverage of the world population. Peptides may displace other peptides already bound to MHC class II or may be taken up by antigen-presenting cells such as dendritic cells which process the peptides and present them in the form of linear peptides bound in the groove of MHC class II. Binding of the T cell receptor to these MHC class II/peptide complexes by CD4+ T cells can trigger an activation cascade causing T cell proliferation. T cell activation may be determined by measuring T cell proliferation using $^3$H-thymidine uptake. Significant immunogenicity may be determined through predetermined statistical assessment of the dataset using the T-test to provide details on magnitude of T cell response based on stimulation index normalization against background/vehicle control. T cell epitopes may then be identified by comparing overlapping immunogenic peptides to identify the core T cell epitope sequence.

In some embodiments, MHC Class II bound peptides processed and presented by dendritic cells (DCs) from Cas proteins may be determined. Combined with ex vivo T cell epitope mapping assays, peptides may be identified that are recognized by CD4+ T cells with the potential to trigger an immune cascade, causing T cell proliferation and leading to anti-drug antibody formation. In some examples, CD14 positive mononuclear cells may be purified from PBMCs and differentiated into immature DCs using GMCSF and IL-4. iDCs may be loaded with test proteins and then matured with LPS. The DCs may take up and process the proteins, presenting them as linear peptides bound in the groove of MHC class II. After incubation with the test sample and LPS, the DCs may be lysed and MHC class II bound peptide complexes may be captured by immunoprecipitation using a pan-HLA-DR antibody. Naturally processed and presented peptides, from the test sample, may be eluted from the captured MHC molecules for subsequent analysis by nano-LC-MS/MS. The eluted peptides may be identified using a common search algorithm and an in-house database. Identified peptides may occur as different length variants. These variants may share the same core HLA-DR binding motif and effectively form a cluster.

Databases are available for screening and prediction of T cell epitopes in silico technologies. Examples of such databases include iTope and T Cell Epitope Database (TCED).

In some embodiments, the Cas proteins may be artificially stressed to induce the formation of sub-visible aggregates of different properties at quantities that may be present in clinical material (after storage and handling). The stressed proteins may be characterized with an orthogonal analytical approach and compared for their immunogenic potential in vitro.

In some embodiments, induction of cytokine production by immune cells in response to the Cas proteins may be determined. By profiling the type and quantity of cytokines induced in vitro, a picture can be established of whether the tested Cas protein induces an immune response. Depending on the anticipated mode of action of the product, an immune response may be unwanted or favorable.

Cas proteins may potentially activate innate and adaptive immune cells resulting in rapid and excessive cytokine release which can lead to cytokine release syndrome (CRS), sometimes referred to as cytokine storm. Elevated serum cytokine concentrations may be measurable in patients within minutes to hours of infusion of the product. A cytokine storm may result in significant and potentially life-threatening toxicity and patients feel very unwell. Assays may be performed to evaluate the risk of Cas proteins causing a cytokine storm. The assays can identify the risk prior to it being progressed into clinical development.

In some examples, an assay may use fresh whole human blood within 4 hours of blood draw, providing close proximity to the state of circulating cells in vivo. The assay may have sensitivity of cytokine detection that allows the measurement of changes in multiple cytokines, such as IL-6, IL-8, IL-10, IFN-γ and TNF-α., in parallel. Multiple reference proteins known to be associated with cytokine release-mediated clinical toxicity may be used to correlate the relative severity of the cytokine response induced by the tested Cas proteins. The assays may combine the quantity, type, and number of cytokines induced with the frequency of donor responses to create a composite picture of the relative risk of test compounds to induce a cytokine storm.

In some embodiments, Tregitopes (T regulatory epitopes) may be identified and introduced to Cas proteins to reduce immunogenicity and induce tolerance.

In some embodiments, the binding potential with respect to a panel of common Class II super-type alleles, covering the majority (e.g., 90%) of the population (e.g., human population) may be determined. In some cases, potential immunogenicity is not randomly distributed throughout protein sequences but instead tends to "cluster" in immunogenic regions (which are often also immunodominant), facilitating the process of deimmunization. A statistical algorithm (e.g., ClustiMer) may be used to screen results sets and identify putative T-cell epitope clusters. The ability to compare peptide scores across multiple alleles may be determined to evaluating the overall immunogenic potential of proteins. For a given Cas protein, the frequency and number of observed hits compared to expected hits may be used as an indicator of overall immunogenic potential. The expectation may be based on an analysis of a large sample of randomly generated sequences with normal amino acid frequencies; the expectation may be expressed as hits per 1000 amino acids to account for the variable sizes of target proteins.

Within proteins, regional immunogenic potential (T cell epitope clusters) can be assessed. Potential immunogenicity may not be evenly distributed across the length of a protein but tends to cluster.

Diminishing the immunogenicity of therapeutic proteins without hindering their function may improve clinical outcomes. This can be accomplished by substituting key amino acids within T cell epitope sequences which abrogate binding to HLA and thereby attenuate epitope potential to trigger a T cell response. In some cases, altered T cell epitopes no longer bind to HLA. Epitope modifications may be evaluated in vitro and in vivo prior to release of the Cas protein for clinical development. To identify amino acids within clusters that are suitable for modification, a "logo report" may be created for each of the immunogenic regions. These reports may identify "critical" residues, which contribute most to MHC binding. Also, one can independently choose mutations. In making the selections, one or more of the following may be considered: common mutations, changes tolerated in other species or variants of the target protein, published information describing residues important to structure and/or function and, if structural models are available, predicted impacts on tertiary structure. "Key" amino acids, may be highlighted in the logo report. Given this list of targeted amino acids and viable alternatives possible alternative sequences may be evaluated and a list of the best single amino acid changes, the best double changes, the best triple changes, and, even more complex changes, may be compiled. The de-immunized sequences may then be validated (in vitro) before being integrated into the protein and tested for functionality (in-vivo).

In some embodiments, immunodominant determinants, rather than all peptides capable of binding to class II HLA, may be modified. For example, the modifications may be limited to one or two amino acids per immunodominant region thus further reducing the impact on protein function. The modification of a few immunodominant epitopes with promiscuous binding may reduce immunogenicity of the Cas proteins.

Each of the identified epitopes and corresponding variants may be tested as peptides in-vitro for binding affinity with respect to a panel of MHC Class II alleles. The HLA cell free binding assay may serve as a "first pass" screen for confirming epitopes and de-immunized peptides. Any cluster that is not confirmed to bind may not need deimmunizing modifications.

In a binding assay screen, an unmodified peptide and its modified counterparts may be compared in their binding affinity for five HLA alleles. The unmodified peptide may bind with high affinity across three of four tested HLA alleles. Strategic modifications to this sequence confer disruption of binding. Failure to bind to HLA is usually indicative of lower immunogenicity in T cell assays.

The next step in the deimmunization process may be to integrate the modifications present in the de-immunized T-cell epitope clusters into the full-length protein. Expressed proteins may be purified, tested for function in vitro and for immunogenicity in HLA transgenic mice.

Tregitopes include a set of peptides that have the ability to call off the body's immune response and can induce tolerance to co-administered antigens. When appropriate, Tregitopes can be incorporated into the deimmunization. In some cases, Tregitopes include a set of peptides that specifically activate CD4+CD25+ FoxP3+ natural regulatory T cells (nTregs). Tregitopes may be promiscuous MHC Class II T cell epitopes located in the Fc and framework regions of Fab from IgG. In vitro, co-incubation of antigens with Tregitopes may lead to suppression of effector cytokine and chemokine secretion, reduced proliferation of effector T cells, and expansion of antigen-specific adaptive Tregs (aTregs). In vivo, co-administration of Tregitopes with a wide range of proteins (such as FVIII, thyroid stimulating hormone receptor, ovalbumin, and autoantigens) may lead to suppression of T cell and antibody responses to test antigens.

Examples of deimmunization methods also include those described in Parker AS et al., Structure-Guided Deimmunization of Therapeutic Proteins, J Comput Biol. 2013 February; 20(2): 152-165.

Screening and Selection of Cas Proteins with Reduced Immunogenicity

Using in silico methods such as described herein, highly functional Cas proteins, including various combinations of mutations, can be produced. Mutable amino acids at positions in a CRISPR protein, including but not limited to catalytic amino acids, nucleic acid-binding amino acids, surface amino acids can be selected and Cas variants produced are predicted to have lower immunogenicity while retaining stability and desired activity. In certain embodiments, mutations are evaluated for expression and activity and mutations selected, and the deimmunization process repeated. Resulting designs can be chosen and experimentally tested. CRISPR variants that are capable of being expressed can be purified and further characterized for activity, stability and immunogenicity.

Thus, the in silico methods can be combined with expression and characterization of the Cas proteins in vitro or in vivo. Furthermore, Cas proteins, including but not limited to variants developed in silico, can be beneficially mutated and/or selected, for example to achieve desired target binding and/or target cleavage. Cas proteins can be mutated and screened or selected by phage display. For example, to screen for Cas binding, a phage library can be developed that expresses mutants of a catalytically dead Cas proteins and screen or select mutants that form a complex with a guide and bind to an immobilized target. Procedures in silico, in vitro, and/or in vivo can be used repeatedly in any combination and order.

A useful procedure related to phage-display, is phage-assisted continuous evolution (PACE), which harnesses bacteriophage to continuously evolve proteins or nucleic acids toward desired functions in vivo. More particularly, the phage's ability to reproduce is linked to a desired molecular functionality such that improvement in the desired functionality is increases the replicative success of the phage. In the case of the filamentous bacteriophage M13, a gene required for phage infection (gene III) is moved from the phage genome to the host genome or to an accessory plasmid (AP) carried by the host and replication of a selection phage (SP) lacking gene III becomes dependent on production of the gene III produce (pIII) by the host. A gene encoding a function to be evolved is inserted into the selection phage (SP), and the host cell is engineered to express the gene III product (pIII protein) in proportion to the evolving function.

Additionally, a mutagenesis plasmid (MP) may be inserted in the host cells in order to increase the error rate during DNA replication. PACE requires no intervention during evolution and obviates the need to create DNA libraries, transform cells, extract genes, or perform DNA cloning steps during each round. Esvelt, K. M., Carlson, J. C. & Liu, D. R. (2011). A system for the continuous directed evolution of biomolecules. Nature, 472(7344):499-503. Esvelt evolved T7 RNA polymerases that recognize a distinct promoter, initiate transcripts with A instead of G, and initiate transcripts with C. Esvelt also linked protein-protein binding and recombinase activity to phage infectivity in discrete infection assays by creating variants of the AP that associate each of these activities with pIII production.

In some instances, it will be desirable to provide evolutionary stepping stones, for example where the initial activity and desired activity are far apart. The stepping stones guide evolving gene populations through points in a fitness landscape that bring them successively closer to the desired activity. Packer et al., 2017, "Phage-assisted continuous evolution of proteases with altered substrate specificity," Nature Communications 8:956, performed PACE of TEV protease, which canonically cleaves ENLYFQS (SEQ ID NO: 256), to cleave a very different target sequence, HPLVGHM (SEQ ID NO: 257), that is present in human IL-23. Simply replacing the TEV consensus substrate with the target peptide resulted in failure of the phage to propagate, consistent with the inability of wild-type TEV protease, or TEV variants containing a handful of immediately accessible mutations, to cleave the target IL-23 peptide. The authors therefore introduced selected substrate changes one stepping stone at a time to avoid collapse of the evolving phage population.

PACE has been used to broaden PAM compatibility and increase target specificity of SpCas9. See, Hu et al., 2018, Evolved Cas9 variants with broad PAM compatibility and high DNA specificity, Nature 556:57 doi: 10.1038/nature26155. Epub 2018 Feb. 28. To link Cas9 DNA recognition to phage propagation during PACE, the authors employed a bacterial one-hybrid selection in which the SP encodes a catalytically dead SpCas9 (dCas9) fused to the ω subunit of bacterial RNA polymerase. When the fusion bound an AP-encoded sgRNA and a PAM and protospacer upstream of gene III in the AP, RNA polymerase recruitment caused gene III expression and phage propagation.

According to the invention, PACE is useful for maintaining and/or modulating function of reduced immunogenicity CRISPR proteins and conjugates. In one non-limiting example, an SP encodes a dead CRISPR proteins fused to the ω subunit of bacterial RNA polymerase wherein the CRISPR protein further comprises one or more mutations designed to reduce immunogenicity and the AP encodes an sgRNA and a PAM and protospacer upstream of gene III in the AP. Mutations in the reduced immunogenicity CRISPR that restore or improve CRISPR-crRNA complex formation and binding to the PAM-containing target cause increased gene III expression when the RNA polymerase is brought in proximity and thus increase phage propagation.

CRISPR-CAS Systems in General

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). See, e.g., Shmakov et al. (2015) "Discovery and Functional Characterization of Diverse Class 2 CRISPR-Cas Systems", Molecular Cell, DOI: dx.doi.org/10.1016/j.molcel.2015.10.008.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein H is A, C or U.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

CRISPR systems and Cas proteins may be from or derived from *Aeropyrum*, *Pyrobaculum*, *Sulfolobus*, *Archaeoglobus*, *Halocarcula*, *Methanobacterium*, *Methanococcus*, *Methanosarcina*, *Methanopyrus*, *Pyrococcus*, *Picrophilus*, *Thermoplasma*, *Corynebacterium*, *Mycobacterium*, *Streptomyces*, *Aquifex*, *Porphyromonas*, *Chlorobium*, *Thermus*, *Bacillus*, *Listeria*, *Staphylococcus*, *Clostridium*, *Thermoanaerobacter*, *Mycoplasma*, *Fusobacterium*, *Azarcus*, *Chromobacterium*, *Neisseria*, *Nitrosomonas*, *Desulfovibrio*, *Geobacter*, *Myxococcus*, *Campylobacter*, *Wolinella*, *Acinetobacter*, *Erwinia*, *Escherichia*, *Legionella*, *Methylococcus*, *Pasteurella*, *Photobacterium*, *Salmonella*, *Xanthomonas*, *Yersinia*, *Treponema*, and *Thermotoga*.

In certain example embodiments, the CRISPR effector protein may be delivered using a nucleic acid molecule encoding the CRISPR effector protein. The nucleic acid molecule encoding a CRISPR effector protein, may advantageously be a codon optimized CRISPR effector protein. An example of a codon optimized sequence, is in this instance a sequence optimized for expression in eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR effector protein is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell.

Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

In certain aspects the invention involves vectors, e.g. for delivering or introducing in a cell Cas and/or RNA capable of guiding Cas to a target locus (e.g., guide RNA), but also for propagating these components (e.g. in prokaryotic cells).

The embodiments disclosed herein may also comprise transgenic cells comprising the CRISPR effector system. In certain example embodiments, the transgenic cell may function as an individual discrete volume. In other words samples comprising a masking construct may be delivered to a cell, for example in a suitable delivery vesicle and if the target is present in the delivery vesicle the CRISPR effector is activated and a detectable signal generated.

Additional effectors for use according to the invention can be identified by their proximity to cas1 genes, for example, though not limited to, within the region 20 kb from the start of the cas1 gene and 20 kb from the end of the cas1 gene. In certain embodiments, the effector protein comprises at least one HEPN domain and at least 500 amino acids, and wherein the C2c2 effector protein is naturally present in a prokaryotic genome within 20 kb upstream or downstream of a Cas gene or a CRISPR array. In some examples, a CRISPR-Cas system comprises a Cas effector protein and guide RNA. Examples of Cas proteins include those of Class 1 (e.g., Type I, Type III, and Type IV) and Class 2 (e.g., Type II, Type V, and Type VI) Cas proteins, e.g., Cas9, Cas12 (e.g., Cas12a, Cas12b, Cas12c, Casl2d), Cas13 (e.g., Cas13a, Cas13b, Cas13c, Casl3d,), CasX, CasY, Cas14, variants thereof (e.g., mutated forms, truncated forms), homologs thereof, and orthologs thereof. In some examples, the Cas effector protein is Cas9. In some examples, the Cas effector protein is Cas12. In some examples, the Cas effector protein is Cas13. Additional effectors for use according to the invention can be identified by their proximity to cas1 genes, for example, though not limited to, within the region 20 kb from the start of the cas1 gene and 20 kb from the end of the cas1 gene. Other examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmrl, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof.

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related.

The present disclosure provides nucleic acid-targeting systems with reduced immunogenicity. In general, "nucleic acid-targeting system" as used in the present application refers collectively to transcripts and other elements involved in the expression of or directing the activity of nucleic acid-targeting CRISPR-associated ("Cas") genes (also referred to herein as an effector protein), including sequences encoding a nucleic acid-targeting Cas (effector) protein and a guide RNA (comprising crRNA sequence and a trans-activating CRISPR/Cas system RNA (tracrRNA) sequence), or other sequences and transcripts from a nucleic acid-targeting CRISPR locus. In some embodiments, one or more elements of a nucleic acid-targeting system are derived from a Type II, Type V, and/or Type VI nucleic acid-targeting CRISPR system. In some embodiments, one or more elements of a nucleic acid-targeting system is derived from a particular organism comprising an endogenous nucleic acid-targeting CRISPR system. In general, a nucleic acid-targeting system is characterized by elements that promote the formation of a nucleic acid-targeting complex at the site of a target sequence. In the context of formation of a nucleic acid-targeting complex, "target sequence" refers to a sequence to which a guide sequence is designed to have complementarity, where hybridization between a target sequence and a guide RNA promotes the formation of a DNA or RNA-targeting complex. Full complementarity is not necessarily required, provided there is sufficient complementarity to cause hybridization and promote formation of a nucleic acid-targeting complex. A target sequence may comprise RNA polynucleotides. In some embodiments, a target sequence is located in the nucleus or cytoplasm of a cell. In some embodiments, the target sequence may be within an organelle of a eukaryotic cell, for example, mitochondrion or chloroplast. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination.

A CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to target, e.g. have complementarity, where hybridization between a target sequence and a guide sequence promotes the formation of a CRISPR complex. The section of the guide sequence through which complementarity to the target sequence is important for cleavage activity is referred to herein as the seed sequence. A target sequence may comprise any polynucleotide, such as DNA or RNA polynucleotides and is comprised within a target locus of interest. In some embodiments, a target sequence is located in the nucleus or cytoplasm of a cell.

In general, the term "guide sequence" is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a nucleic acid-targeting complex to a target sequence may be assessed by any suitable assay (as described in EP3009511 or US2016208243). For example, the components of a nucleic acid-targeting system sufficient to form a nucleic acid-targeting complex, including the guide sequence to be tested, may be provided to a host cell having the corresponding target sequence, such as by transfection with vectors encoding the components of the nucleic acid-targeting CRISPR sequence, followed by an assessment of preferential cleavage within or in the vicinity of the target sequence, such as by Surveyor assay as described herein. Similarly, cleavage of a target polynucleotide sequence (or a sequence in the vicinity thereof) may be evaluated in a test tube by providing the target sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art. Guide A guide sequence may be selected to target any target sequence. In some embodiments, the target sequence is a sequence within a gene transcript or mRNA. In some embodiments, the target sequence is a sequence within a genome of a cell.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, Cell 106(1): 23-24; and PA Carr and GM Church, 2009, *Nature Biotechnology* 27(12): 1151-62). Further algorithms may be found in U.S. application Serial No. TBA; incorporated herein by reference.

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence. For the Cpf1 orthologs identified to date, the direct repeat is located upstream 5' of the guide sequence.

In relation to a nucleic acid-targeting complex or system preferably, the crRNA sequence has one or more stem loops or hairpins and is 30 or more nucleotides in length, 40 or more nucleotides in length, or 50 or more nucleotides in length; In certain embodiments, the crRNA sequence is between 42 and 44 nucleotides in length, and the nucleic acid-targeting Cas protein is Cpf1 of *Franciscella tularensis* subsp.novocida U112. In certain embodiments, the crRNA comprises, consists essentially of, or consists of 19 nucleotides of a direct repeat and between 23 and 25 nucleotides of spacer sequence, and the nucleic acid-targeting Cas protein is Cpf1 of *Franciscella tularensis* subsp.novocida U112.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

In some embodiments, the direct repeat has a minimum length of 16 nts and a single stem loop. In further embodiments the direct repeat has a length longer than 16 nts, preferably more than 17 nts, and has more than one stem loop or optimized secondary structures. In some embodiments, the guide sequence is at least 16, 17, 18, 19, 20, 25 nucleotides, or between 16-30, or between 16-25, or between 16-20 nucleotides in length.

In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

The "tracrRNA" sequence or analogous terms includes any polynucleotide sequence that has sufficient complementarity with a crRNA sequence to hybridize. As indicated herein above, in embodiments of the present invention, the tracrRNA is not required for cleavage activity of Cas protein complexes.

Cas Proteins

Accordingly, when referring to the CRISPR system herein, in some aspects or embodiments, the CRISPR system comprises (i) a CRISPR protein or a polynucleotide encoding a CRISPR effector protein and (ii) one or more polynucleotides engineered to: complex with the CRISPR protein to form a CRISPR complex; and to complex with the target sequence.

In some embodiments, the therapeutic is for delivery (or application or administration) to a eukaryotic cell, either in vivo or ex vivo.

In some embodiments, the CRISPR protein is a nuclease directing cleavage of one or both strands at the location of the target sequence, or wherein the CRISPR protein is a nickase directing cleavage at the location of the target sequence.

In certain example embodiments, the Cas protein is the Cas protein of a Class 2 CRISPR-Cas system (i.e., a Class 2 Cas protein). A Class 2 CRISPR-Cas system may be of a subtype, e.g., Type II-A, Type II-B, Type II-C, Type V-A, Type V-B, Type V-C, or Type V-U, CRISPR-Cas system. In certain example embodiments, the Cas protein is Cas9, Cas12a, Cas12b, Cas12c, or Casl2d. In some embodiments, Cas9 may be SpCas9, SaCas9, StCas9 and other Cas9 orthologs. Cas 12 may be Cas12a, Cas12b, and Cas12c, including FnCas12a, or homology or orthologs thereof. The definition and exemplary members of the CRISPR-Cas system include those described in Kira S. Makarova and Eugene V. Koonin, Annotation and Classification of CRISPR-Cas systems, Methods Mol Biol. 2015; 1311: 47-75; and Sergey Shmakov et al., Diversity and evolution of class 2 CRISPR-Cas systems, Nat Rev Microbiol. 2017 March; 15(3): 169-182.

In some examples, the Cas protein comprises at least one RuvC and at least one HNH domain. In some examples, the Cas comprises at least one RuvC domain but does not comprise an HNH domain.

In some embodiments, the Cas protein may be a Cas protein of a Class 2, Type II CRISPR-Cas system (a Type II Cas protein). In some embodiments, the Cas protein may be a class 2 Type II Cas protein, e.g., Cas9. By "Cas9 (CRISPR associated protein 9)" is meant a polypeptide or fragment thereof having at least about 85% amino acid identity to NCBI Accession No. NP_269215 and having RNA binding activity, DNA binding activity, and/or DNA cleavage activity (e.g., endonuclease or nickase activity). "Cas9 function" can be defined by any of a number of assays including, but not limited to, fluorescence polarization-based nucleic acid bind assays, fluorescence polarization-based strand invasion assays, transcription assays, EGFP disruption assays, DNA cleavage assays, and/or Surveyor assays, for example, as described herein. By "Cas 9 nucleic acid molecule" is meant a polynucleotide encoding a Cas9 polypeptide or fragment thereof. An exemplary Cas9 nucleic acid molecule sequence is provided at NCBI Accession No. NC_002737. In some embodiments, disclosed herein are inhibitors of Cas9, e.g., naturally occurring Cas9 in *S. pyogenes* (SpCas9) or *S. aureus* (SaCas9), or variants thereof. Cas9 recognizes foreign DNA using Protospacer Adjacent Motif (PAM) sequence and the base pairing of the target DNA by the guide RNA (gRNA). The relative ease of inducing targeted strand breaks at any genomic loci by Cas9 has enabled efficient genome editing in multiple cell types and organisms. Cas9 derivatives can also be used as transcriptional activators/repressors.

In certain embodiments, the Cas protein may be a Cas protein of a Class 2, Type V CRISPR-Cas system (a Type V Cas protein). Examples of class 2 Type V Cas proteins include Cas12a (Cpf1), Cas12b (C2c1), Cas12c (C2c3), or Cas12k.

In some examples, the Cas protein is Cpf1. By "Cpf1 (CRISPR associated protein Cpf1)" is meant a polypeptide or fragment thereof having at least about 85% amino acid identity to GenBank Accession No. AJI61006. 1 and having RNA binding activity, DNA binding activity, and/or DNA cleavage activity (e.g., endonuclease or nickase activity). "Cpf1 function" can be defined by any of a number of assays including, but not limited to, fluorescence polarization-based nucleic acid bind assays, fluorescence polarization-based strand invasion assays, transcription assays, EGFP disruption assays, DNA cleavage assays, and/or Surveyor assays, for example, as described herein. By "Cpf1 nucleic acid molecule" is meant a polynucleotide encoding a Cpf1 polypeptide or fragment thereof. An exemplary Cpf1 nucleic acid molecule sequence is provided at GenBank Accession No. CP009633, nucleotides 652838-656740. Cpf1(CRISPR-associated protein Cpf1, subtype PREFRAN) is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in all Cas9 proteins, and the RuvC-like domain is contiguous in the Cpf1 sequence, in contrast to Cas9 where it contains long inserts including the HNH domain. Accordingly, in particular embodiments, the CRISPR-Cas enzyme comprises only a RuvC-like nuclease domain.

The Cpf1 gene is found in several diverse bacterial genomes, typically in the same locus with cas1, cas2, and cas4 genes and a CRISPR cassette (for example, FNFX1_1431-FNFX1_1428 of *Francisella* cf. *novicida* Fx1). Thus, the layout of this putative novel CRISPR-Cas system appears to be similar to that of type II-B. Furthermore, similar to Cas9, the Cpf1 protein contains a readily identifiable C-terminal region that is homologous to the transposon ORF-B and includes an active RuvC-like nuclease, an arginine-rich region, and a Zn finger (absent in Cas9). However, unlike Cas9, Cpf1 is also present in several genomes without a CRISPR-Cas context and its relatively high similarity with ORF-B suggests that it might be a transposon component. It was suggested that if this was a genuine CRISPR-Cas system and Cpf1 is a functional analog of Cas9 it would be a novel CRISPR-Cas type, namely type V (See Annotation and Classification of CRISPR-Cas Systems. Makarova KS, Koonin EV. Methods Mol Biol. 2015; 1311:47-75). However, as described herein, Cpf1 is denoted to be in subtype V-A to distinguish it from C2clp which does not have an identical domain structure and is hence denoted to be in subtype V-B.

In some examples, the Cas protein is Cc2cl. The C2cl gene is found in several diverse bacterial genomes, typically in the same locus with cas1, cas2, and cas4 genes and a CRISPR cassette. Thus, the layout of this putative novel CRISPR-Cas system appears to be similar to that of type II-B. Furthermore, similar to Cas9, the C2cl protein contains an active RuvC-like nuclease, an arginine-rich region, and a Zn finger (absent in Cas9). C2c1 (Cas12b) is derived from a C2c1 locus denoted as subtype V-B. Herein such effector proteins are also referred to as "C2clp", e.g., a C2c1 protein (and such effector protein or C2cl protein or protein derived from a C2cl locus is also called "CRISPR enzyme"). Presently, the subtype V-B loci encompasses cas1-Cas4 fusion, cas2, a distinct gene denoted C2cl and a CRISPR array. C2cl (CRISPR-associated protein C2cl) is a large protein (about 1100-1300 amino acids) that contains a RuvC-like nuclease domain homologous to the corresponding domain of Cas9 along with a counterpart to the characteristic arginine-rich cluster of Cas9. However, C2cl lacks the HNH nuclease domain that is present in all Cas9 proteins, and the RuvC-like domain is contiguous in the C2cl sequence, in contrast to Cas9 where it contains long inserts including the HNH domain. Accordingly, in particular embodiments, the CRISPR-Cas enzyme comprises only a RuvC-like nuclease domain.

C2c 1 proteins are RNA guided nucleases. Its cleavage relies on a tracr RNA to recruit a guide RNA comprising a guide sequence and a direct repeat, where the guide sequence hybridizes with the target nucleotide sequence to form a DNA/RNA heteroduplex. Based on current studies, C2cl nuclease activity also requires relies on recognition of PAM sequence. C2cl PAM sequences may be T-rich sequences. In some embodiments, the PAM sequence is 5' TTN 3' or 5' ATTN 3', wherein N is any nucleotide. In a particular embodiment, the PAM sequence is 5' TTC 3'. In a particular embodiment, the PAM is in the sequence of *Plasmodium falciparum*. C2cl creates a staggered cut at the target locus, with a 5' overhang, or a "sticky end" at the PAM distal side of the target sequence. In some embodiments, the 5' overhang is 7 nt. See Lewis and Ke, Mol Cell. 2017 Feb. 2; 65(3):377-379.

In some embodiments, the Cas protein is a Type VI Cas, e.g., Cas13a, Cas13b, Cas13c, Casl3d.

In some embodiments, the CRISPR protein is a Cpf1 protein complexed with a CRISPR-Cas system RNA polynucleotide sequence, wherein the polynucleotide sequence comprises: a) a guide RNA polynucleotide capable of hybridizing to a target HBV sequence; and (b) a direct repeat RNA polynucleotide.

In some embodiments, the CRISPR protein is a Cpf1, and the system comprises: I. a CRISPR-Cas system RNA polynucleotide sequence, wherein the polynucleotide sequence comprises: (a) a guide RNA polynucleotide capable of hybridizing to a target sequence, and (b) a direct repeat RNA polynucleotide, and II. a polynucleotide sequence encoding the Cpf1, optionally comprising at least one or more nuclear localization sequences, wherein the direct repeat sequence hybridizes to the guide sequence and directs sequence-specific binding of a CRISPR complex to the target sequence, and wherein the CRISPR complex comprises the CRISPR protein complexed with (1) the guide sequence that is hybridized or hybridizable to the target sequence, and (2) the direct repeat sequence, and the polynucleotide sequence encoding a CRISPR protein is DNA or RNA.

In some embodiments, the CRISPR protein is a Cpf1 from *Acidaminococcus* sp. BV3L6 (AsCpf1), Lachnospiraceae bacterium ND2006 (LbCpf1) or *Moraxella bovoculi* 237.

In some embodiments, the CRISPR protein further comprises one or more nuclear localization sequences (NLSs) capable of driving the accumulation of the CRISPR protein to a detectable amount in the nucleus of the cell of the organism.

In some embodiments, the CRISPR protein comprises one or more mutations.

In some embodiments, the CRISPR protein has one or more mutations in a catalytic domain, and wherein the protein further comprises a functional domain.

In some embodiments, the CRISPR system is comprised within a delivery system, optionally: a vector system comprising one or more vectors, optionally wherein the vectors comprise one or more viral vectors, optionally wherein the one or more viral vectors comprise one or more lentiviral, adenoviral or adeno-associated viral (AAV) vectors; or a particle or lipid particle, optionally wherein the CRISPR protein is complexed with the polynucleotides to form the CRISPR complex.

In some embodiments, the system, complex or protein is for use in a method of modifying an organism or a non-human organism by manipulation of a target sequence in a genomic locus of interest.

In some embodiments, the polynucleotides encoding the sequence encoding or providing the CRISPR system are delivered via liposomes, particles, cell penetrating peptides, exosomes, microvesicles, or a gene-gun. In some embodiments, a delivery system is included. In some embodiments, the delivery system comprises: a vector system comprising one or more vectors comprising the engineered polynucleotides and polynucleotide encoding the CRISPR protein, optionally wherein the vectors comprise one or more viral vectors, optionally wherein the one or more viral vectors comprise one or more lentiviral, adenoviral or adeno-associated viral (AAV) vectors; or a particle or lipid particle, containing the CRISPR system or the CRISPR complex.

In some embodiments, the CRISPR protein has one or more mutations in a catalytic domain, and wherein the enzyme further comprises a functional domain.

In some embodiments, a recombination/repair template is provided.

Exemplary Cas Proteins

The following are exemplary Cas proteins that can be deimmunized:

TABLE 2

| | Cas9 orthologs | | | | |
|---|---|---|---|---|---|
| S. pyogenes Cas9 (SEQ ID NO. 1) | MDKKYSIGLD | IGTNSVGWAV | ITDEYKVPSK | KFKVLGNTDR | HSIKKNLIGA |
| | LLFDSGETAE | ATRLKRTARR | RYTRRKNRIC | YLQEIFSNEM | AKVDDSFFHR |
| | LEESFLVEED | KKHERHPIFG | NIVDEVAYHE | KYPTIYHLRK | KLVDSTDKAD |
| | LRLIYLALAH | MIKFRGHFLI | EGDLNPDNSD | VDKLFIQLVQ | TYNQLFEENP |
| | INASGVDAKA | ILSARLSKSR | RLENLIAQLP | GEKKNGLFGN | LIALSLGLTP |
| | NFKSNFDLAE | DAKLQLSKDT | YDDDLDNLLA | QIGDQYADLF | LAAKNLSDAI |
| | LLSDILRVNT | EITKAPLSAS | MIKRYDEHHQ | DLTLLKALVR | QQLPEKYKEI |
| | FFDQSKNGYA | GYIDGGASQE | EFYKFIKPIL | EKMDGTEELL | VKLNREDLLR |
| | KQRTFDNGSI | PHQIHLGELH | AILRRQEDFY | PFLKDNREKI | EKILTFRIPY |
| | YVGPLARGNS | RFAWMTRKSE | ETITPWNFEE | VVDKGASAQS | FIERMTNFDK |
| | NLPNEKVLPK | HSLLYEYFTV | YNELTKVKYV | TEGMRKPAFL | SGEQKKAIVD |
| | LLFKTNRKVT | VKQLKEDYFK | KIECFDSVEI | SGVEDRFNAS | LGTYHDLLKI |
| | IKDKDFLDNE | ENEDILEDIV | LTLTLFEDRE | MIEERLKTYA | HLFDDKVMKQ |
| | LKRRRYTGWG | RLSRKLINGI | RDKQSGKTIL | DFLKSDGFAN | RNFMQLIHDD |
| | SLTFKEDIQK | AQVSGQGDSL | HEHIANLAGS | PAIKKGILQT | VKVVDELVKV |
| | MGRHKPENIV | IEMARENQTT | QKGQKNSRER | MKRIEEGIKE | LGSQILKEHP |
| | VENTQLQNEK | LYLYYLQNGR | DMYVDQELDI | NRLSDYDVDH | IVPQSFLKDD |
| | SIDNKVLTRS | DKNRGKSDNV | PSEEVVKKMK | NYWRQLLNAK | LITQRKFDNL |
| | TKAERGGLSE | LDKAGFIKRQ | LVETRQITKH | VAQILDSRMN | TKYDENDKLI |
| | REVKVITLKS | KLVSDFRKDF | QFYKVREINN | YHHAHDAYLN | AVVGTALIKK |
| | YPKLESEFVY | GDYKVYDVRK | MIAKSEQEIG | KATAKYFFYS | NIMNFFKTEI |
| | TLANGEIRKR | PLIETNGETG | EIVWDKGRDF | ATVRKVLSMP | QVNIVKKTEV |
| | QTGGFSKESI | LPKRNSDKLI | ARKKDWDPKK | YGGFDSPTVA | YSVLVVAKVE |
| | KGKSKKLKSV | KELLGITIME | RSSFEKNPID | FLEAKGYKEV | KKDLIIKLPK |
| | YSLFELENGR | KRMLASAGEL | QKGNELALPS | KYVNFLYLAS | HYEKLKGSPE |
| | DNEQKQLFVE | QHKHYLDEII | EQISEFSKRV | ILADANLDKV | LSAYNKHRDK |
| | PIREQAENII | HLFTLTNLGA | PAAFKYFDTT | IDRKRYTSTK | EVLDATLIHQ |
| | SITGLYETRI | DLS | | | |
| S. aureus Cas9 (SEQ ID NO. 2) | MKRNYILGLD | IGITSVGYGI | IDYETRDVID | AGVRLFKEAN | VENNEGRRSK |
| | RGARRLKRRR | RHRIQRVKKL | LFDYNLLTDH | SELSGINPYE | ARVKGLSQKL |
| | SEEEFSAALL | HLAKRRGVHN | VNEVEEDTGN | ELSTKEQISR | NSKALEEKYV |
| | AELQLERLKK | DGEVRGSINR | FKTSDYVKEA | KQLLKVQKAY | HQLDQSFIDT |
| | YIDLLETRRT | YYEGPGEGSP | FGWKDIKEWY | EMLMGHCTYF | PEELRSVKYA |
| | YNADLYNALN | DLNNLVITRD | ENEKLEYYEK | FQIIENVFKQ | KKKPTLKQIA |
| | KEILVNEEDI | KGYRVTSTGK | PEFTNLKVYH | DIKDITARKE | IIENAELLDQ |
| | IAKILTIYQS | SEDIQEELTN | LNSELTQEEI | EQISNLKGYT | GTHNLSLKAI NLILDELWHT |
| | NDNQIAIFNR | LKLVPKKVDL | SQQKEIPTTL | VDDFILSPVV | KRSFIQSIKV |
| | INAIIKKYGL | PNDIIIELAR | EKNSKDAQKM | INEMQKRNRQ | TNERIEEIIR |
| | TTGKENAKYL | IEKIKLHDMQ | EGKCLYSLEA | IPLEDLLNNP | FNYEVDHIIP |
| | RSVSFDNSFN | NKVLVKQEEN | SKKGNRTPFQ | YLSSSDSKIS | YETFKKHILN |
| | LAKGKGRISK | TKKEYLLEER | DINRFSVQKD | FINRNLVDTR | YATRGLMNLL |
| | RSYFRVNNLD | VKVKSINGGF | TSFLRRKWKF | KKERNKGYKH | HAEDALIIAN |
| | ADFIFKEWKK | LDKAKKVMEN | QMFEEKQAES | MPEIETEQEY | KEIFITPHQI |
| | KHIKDFKDYK | YSHRVDKKPN | RELINDTLYS | TRKDDKGNTL | IVNNLNGLYD |
| | KDNDKLKKLI | NKSPEKLLMY | HHDPQTYQKL | KLIMEQYGDE | KNPLYKYYEE |
| | TGNYLTKYSK | KDNGPVIKKI | KYYGNKLNAH | LDITDDYPNS | RNKVVKLSLK |
| | PYRFDVYLDN | GVYKFVTVKN | LDVIKKENYY | EVNSKCYEEA | KKLKKISNQA |
| | EFIASFYNND | LIKINGELYR | VIGVNNDLLN | RIEVNMIDIT | YREYLENMND |
| | KRPPRIIKTI | ASKTQSIKKY | STDILGNLYE | VKSKKHPQII | KKG |
| Campylobacter jejuni Cas9 WP_002864485.1 (SEQ ID NO. 3) | MARILAFDIG | ISSIGWAFSE | NDELKDCGVR | IFTKVENPKT | GESLALPRRL |
| | ARSARKRLAR | RKARLNHLKH | LIANEFKLNY | EDYQSFDESL | AKAYKGSLIS |
| | PYELRFRALN | ELLSKQDFAR | VILHIAKRRG | YDDIKNSDDK | EKGAILKAIK |
| | QNEEKLANYQ | SVGEYLYKEY | FQKFKENSKE | FTNVRNKKES | YERCIAQSFL |
| | KDELKLIFKK | QREFGFSFSK | KFEEEVLSVA | FYKRALKDFS | HLVGNCSFFT |
| | DEKRAPKNSP | LAFMFVALTR | IINLLNNLKN | TEGILYTKDD | LNALLNEVLK |
| | NGTLTYKQTK | KLLGLSDDYE | FKGEKGTYFI | EFKKYKEFIK | ALGEHNLSQD |
| | DLNEIAKDIT | LIKDEIKLKK | ALAKYDLNQN | QIDSLSKLEF | KDHLNISFKA |
| | LKLVTPLMLE | GKKYDEACNE | LNLKVAINED | KKDFLPAFNE | TYYKDEVTNP |
| | VVLRAIKEYR | KVLNALLKKY | GKVHKINIEL | AREVGKNHSQ | RAKIEKEQNE |
| | NYKAKKDAEL | ECEKLGLKIN | SKNILKLRLF | KEQKEFCAYS | GEKIKISDLQ |
| | DEKMLEIDHI | YPYSRSFDDS | YMNKVLVFTK | QNQEKLNQTP | FEAFGNDSAK |
| | WQKIEVLAKN | LPTKKQKRIL | DKNYKDKEQK | NFKDRNLNDT | RYIARLVLNY |
| | TKDYLDFLPL | SDDENTKLND | TQKGSKVHVE | AKSGMLTSAL | RHTWGFSAKD |
| | RNNHLHHAID | AVIIAYANNS | IVKAFSDFKK | EQESNSAELY | AKKISELDYK |
| | NKRKFFEPFS | GFRQKVLDKI | DEIFVSKPER | KKPSGALHEE | TFRKEEEFYQ |
| | SYGGKEGVLK | ALELGKIRKV | NGKIVKNGDM | FRVDIFKHKK | TNKFYAVPIY |

TABLE 2-continued

Cas9 orthologs

|  |  |
|---|---|
| | TMDFALKVLP NKAVARSKKG EIKDWILMDE NYEFCFSLYK DSLILIQTKD<br>MQEPEFVYYN AFTSSTVSLI VSKHDNKFET LSKNQKILFK NANEKEVIAK<br>SIGIQNLKVF EKYIVSALGE VTKAEFRQRE DFKK |
| *S. thermophilus*<br>Cas9<br>WP_011680957.1<br>(SEQ ID NO. 4) | MSDLVLGLDI GIGSVGVGIL NKVTGEIIHK NSRIFPAAQA ENNLVRRTNR<br>QGRRLARRKK HRRVRLNRLF EESGLITDFT KISINLNPYQ LRVKGLTDEL<br>SNEELFIALK NMVKHRGISY LDDASDDGNS SVGDYAQIVK ENSKQLETKT<br>PGQIQLERYQ TYGQLRGDFT VEKDGKKHRL INVFPTSAYR SEALRILQTQ<br>QEFNPQITDE FINRYLEILT GKRKYYHGPG NEKSRTDYGR YRTSGETLDN<br>IFGILIGKCT FYPDEFRAAK ASYTAQEFNL LNDLNNLTVP TETKKLSKEQ<br>KNQIINYVKN EKAMGPAKLF KYIAKLLSCD VADIKGYRID KSGKAEIHTF<br>EAYRKMKTLE TLDIEQMDRE TLDKLAYVLT LNTEREGIQE ALEHEFADGS<br>FSQKQVDELV QFRKANSSIF GKGWHNFSVK LMMELIPELY ETSEEQMTIL<br>TRLGKQKTTS SSNKTKYIDE KLLTEEIYNP VVAKSVRQAI KIVNAAIKEY<br>GDFDNIVIEM ARETNEDDEK KAIQKIQKAN KDEKDAAMLK AANQYNGKAE<br>LPHSVFHGHK QLATKIRLWH QQGERCLYTG KTISIHDLIN NSNQFEVDHI<br>LPLSITFDDS LANKVLVYAT ANQEKGQRTP YQALDSMDDA WSFRELKAFV<br>RESKTLSNKK KEYLLTEEDI SKFDVRKKFI ERNLVDTRYA SRVVLNALQE<br>HFRAHKIDTK VSVVRGQFTS QLRRHWGIEK TRDTYHHHAV DALIIAASSQ<br>LNLWKKQKNT LVSYSEDQLL DIETGELISD DEYKESVFKA PYQHFVDTLK<br>SKEFEDSILF SYQVDSKFNR KISDATIYAT RQAKVGKDKA DETYVLGKIK<br>DIYTQDGYDA FMKIYKKDKS KFLMYRHDPQ TFEKVIEPIL ENYPNKQINE<br>KGKEVPCNPF LKYKEEHGYI RKYSKKGNGP EIKSLKYYDS KLGNHIDITP<br>KDSNNKVVLQ SVSPWRADVY FNKTTGKYEI LGLKYADLQF EKGTGTYKIS<br>QEKYNDIKKK EGVDSDSEFK FTLYKNDLLL VKDTETKEQQ LFRFLSRTMP<br>KQKHYVELKP YDKQKFEGGE ALIKVLGNVA NSGQCKKGLG KSNISIYKVR<br>TDVLGNQHII KNEGDKPKLD F |
| *Parvibaculum*<br>*lavamentivorans*<br>Cas9<br>WP_011995013.1<br>(SEQ ID NO. 5) | MERIFGFDIG TTSIGFSVID YSSTQSAGNI QRLGVRIFPE ARDPDGTPLN<br>QQRRQKRMMR RQLRRRRIRR KALNETLHEA GFLPAYGSAD WPVVMADEPY<br>ELRRRGLEEG LSAYEFGRAI YHLAQHRHFK GRELEESDTP DPDVDDEKEA<br>ANERAATLKA LKNEQTTLGA WLARRPPSDR KRGIHAHRNV VAEEFERLWE<br>VQSKFHPALK SEEMRARISD TIFAQRPVFW RKNTLGECRF MPGEPLCPKG<br>SWLSQQRRML EKLNNNLAIAG GNARPLDAEE RDAILSKLQQ QASMSWPGVR<br>SALKALYKQR GEPGAEKSLK FNLELGGESK LLGNALEAKL ADMFGPDWPA<br>HPRKQEIRHA VHERLWAADY GETPDKKRVI ILSEKDRKAH REAAANSFVA<br>DFGITGEQAA QLQALKLPTG WEPYSIPALN LFLAELEKGE RFGALVNGPD<br>WEGWRRTNFP HRNQPTGEIL DKLPSPASKE ERERISQLRN PTVVRTQNEL<br>RKVVNNLIGL YGKPDRIRIE VGRDVGKSKR EREEIQSGIR RNEKQRKKAT<br>EDLIKNGIAN PSRDDVEKWI LWKEGQERCP YTGDQIGFNA LFREGRYEVE<br>HIWPRSRSFD NSPRNKTLCR KDVNIEKGNR MPFEAFGHDE DRWSAIQIRL<br>QGMVSAKGGT GMSPGKVKRF LAKTMPEDFA ARQLNDTRYA AKQILAQLKR<br>LWPDMGPEAP VKVEAVTGQV TAQLRKLWTL NNILADDGEK TRADHRHHAI<br>DALTVACTHP GMTNKLSRYW QLRDDPRAEK PALTPPWDTI RADAEKAVSE<br>IVVSHRVKKK VSGPLHKETT YGDTGTDIKT KSGTYRQFVT RKKIESLSKG<br>ELDEIRDPRI KEIVAAHVAG RGGDPKKAFP PYPCVSPGGP EIRKVRLTSK<br>QQLNLMAQTG NGYADLGSNH HIAIYRLPDG KADFEIVSLF DASRRLAQRN<br>PIVQRTRADG ASFVMSLAAG EAIMIPEGSK KGIWIVQGVW ASGQVVLERD<br>TDADHSTTTR PMPNPILKDD AKKVSIDPIG RVRPSND |
| *Corynebacter*<br>*diphtheria* Cas9<br>WP_010933968.1<br>(SEQ ID NO. 6) | MKYHVGIDVG TFSVGLAAIE VDDAGMPIKT LSLVSHIHDS GLDPDEIKSA<br>VTRLASSGIA RRTRRLYRRK RRRLQQLDKF IQRQGWPVIE LEDYSDPLYP<br>WKVRAELAAS YIADEKERGE KLSVALRHIA RHRGWRNPYA KVSSLYLPDG<br>PSDAFKAIRE EIKRASGQPV PETATVGQMV TLCELGTLKL RGEGGVLSAR<br>LQQSDYAREI QEICRMQEIG QELYRKIIDV VFAAESPKGS ASSRVGKDPL<br>QPGKNRALKA SDAFQRYRIA ALIGNLRVRV DGEKRILSVE EKNLVFDHLV<br>NLTPKKEPEW VTIAEILGID RGQLIGTATM TDDGERAGAR PPTHDTNRSI<br>VNSRIAPLVD WWKTASALEQ HAMVKALSNA EVDDFDSPEG AKVQAFFADL<br>DDDVHAKLDS LHLPVGRAAY SEDTLVRLTR RMLSDGVDLY TARLQEFGIE<br>PSWTPPTPRI GEPVGNPAVD RVLKTVSRWL ESATKTWGAP ERVIIEHVRE<br>GFVTEKRARE MDGDMRRRAA RNAKLFQEMQ EKLNVQGKPS RADLWRYQSV<br>QRQNCQCAYC GSPITFSNSE MDHIVPRAGQ GSTNTRENLV AVCHRCNQSK<br>GNTPFAIWAK NTSIEGVSVK EAVERTRHWV TDTGMRSTDF KKFTKAVVER<br>FQRATMDEEI DARSMESVAW MANELRSRVA QHFASHGTTV RVYRGSLTAE<br>ARRASGISGK LKFFDGVGKS RLDRRHHAID AAVIAFTSDY VAETLAVRSN<br>LKQSAHRQE APQWREFTGK DAEHRAAWRV WCQKMEKLSA LLTEDLRDDR<br>VVVMSNVRLR LGNGSAHKET IGKLSKVKLS SQLSVSDIDK ASSEALWCAL<br>TREPGFDPKE GLPANPERHI RVNGTHVYAG DNIGLFPVSA GSIALRGGYA<br>ELGSSFHHAR VYKITSGKKP AFAMLRVYTI DLLPYRNQDL FSVELKPQTM<br>SMRQEEKKLR DALATGNAEY LGWLVVDDEL VVDTSKIATD QVKAVEAELG<br>TIRRWRVDGF FSPSKLRLRP LQMSKEGIKK ESAPELSKII DRPGWLPAVN<br>KLFSDGNVTV VRRDSLGRVR LESTAHLPVT WKVQ |
| *Streptococcus*<br>*pasteurianus*<br>Cas9<br>(SEQ ID NO. 7) | MTNGKILGLD IGIASVGVGI IEAKTGKVVH ANSRLFSAAN AENNAERRGF<br>RGSRRLNRRK KHRVKRVRDL FEKYGIVTDF RNLNLNPYEL RVKGLTEQLK<br>NEELFAALRT ISKRRGISYL DDAEDDSTGS TDAKSIDEN RRLLKNKTPG<br>QIQLERLEKY GQLRGNFTVY DENGEAHRLI NVFSTSDYEK EARKILETQA<br>DYNKKITAEF IDDYVEILTQ KRKYYHGPGN EKSRTDYGRF RTDGTTLENI |

TABLE 2-continued

| Cas9 orthologs | |
|---|---|
| | FGILIGKCNF YPDEYRASKA SYTAQEYNFL NDLNNLKVST ETGKLSTEQK<br>ESLVEFAKNT ATLGPAKLLK EIAKILDCKV DEIKGYREDD KGKPDLHTFE<br>PYRKLKFNLE SINIDDLSRE VIDKLADILT LNTEREGIED AIKRNLPNQF TEEQISEIIK<br>VRKSQSTAFN KGWHSFSAKL MNELIPELYA TSDEQMTILT RLEKFKVNKK<br>SSKNTKTIDE KEVTDEIYNP VVAKSVRQTI KIINAAVKKY GDFDKIVIEM<br>PRDKNADDEK KFIDKRNKEN KKEKDDALKR AAYLYNSSDK LPDEVFHGNK<br>QLETKIRLWY QQGERCLYSG KPISIQELVH NSNNFEIDHI LPLSLSFDDS<br>LANKVLVYAW TNQEKGQKTP YQVIDSMDAA WSFREMKDYV LKQKGLGKKK<br>RDYLLTTENI DKIEVKKKFI ERNLVDTRYA SRVVLNSLQS ALRELGKDTK<br>VSVVRGQFTS QLRRKWKIDK SRETYHHHAV DALIIAASSQ LKLWEKQDNP<br>MFVDYGKNQV VDKQTGEILS VSDDEYKELV FQPPYQGFVN TISSKGFEDE<br>ILFSYQVDSK YNRKVSDATI YSTRKAKIGK DKKEETYVLG KIKDIYSQNG<br>FDTFIKKYNK DKTQFLMYQK DSLTWENVIE VILRDYPTTK KSEDGKNDVK<br>CNPFEEYRRE NGLICKYSKK GKGTPIKSLK YYDKKLGNCI DITPEESRNK<br>VILQSINPWR ADVYFNPETL KYELMGLKYS DLSFEKGTGN YHISQEKYDA<br>IKEKEGIGKK SEFKFTLYRN DLILIKDIAS GEQEIYRFLS RTMPNVNHYV<br>ELKPYDKEKF DNVQELVEAL GEADKVGRCI KGLNKPNISI YKVRTDVLGN<br>KYFVKKKGDK PKLDFKNNKK |
| *Neisseria cinerea* Cas9 WP_003676410.1 (SEQ ID NO. 8) | MAAFKPNPMN YILGLDIGIA SVGWAIVEID EEENPIRLID LGVRVFERAE<br>VPKTGDSLAA ARRLARSVRR LTRRRAHRLL RARRLLKREG VLQAADFDEN<br>GLIKSLPNTP WQLRAAALDR KLTPLEWSAV LLHLIKHRGY LSQRKNEGET<br>ADKELGALLK GVADNTHALQ TGDFRTPAEL ALNKFEKESG HIRNQRGDYS<br>HTFNRKDLQA ELNLLFEKQK EFGNPHVSDG LKEGIETLLM TQRPALSGDA<br>VQKMLGHCTF EPTEPKAAKN TYTAERFVWL TKLNNLRILE QGSERPLTDT<br>ERATLMDEPY RKSKLTYAQA RKLLDLDDTA FFKGLRYGKD NAEASTLMEM<br>KAYHAISRAL EKEGLKDKKS PLNLSPELQD EIGTAFSLFK TDEDITGRLK<br>DRVQPEILEA LLKHISFDKF VQISLKALRR IVPLMEQGNR YDEACTEIYG<br>DHYGKKNTEE KIYLPPIPAD EIRNPVVLRA LSQARKVING VVRRYGSPAR<br>IHIETAREVG KSFKDRKEIE KRQEENRKDR EKSAAKFREY FPNFVGEPKS<br>KDILKLRLYE QQHGKCLYSG KEINLGRLNE KGYVEIDHAL PFSRTWDDSF<br>NNKVLALGSE NQNKGNQTPY EYENGKDNSR EWQEFKARVE TSRFPRSKKQ<br>RILLQKFDED GFKERNLNDT RYINRFLCQF VADHMLLTGK GKRRVFASNG<br>QITNLLRGFW GLRKVRAEND RHHALDAVVV ACSTIAMQQK ITRFVRYKEM<br>NAFDGKTIDK ETGEVLHQKA HPPQPWEFFA QEVMIRVEGK PDGKPEFEEA<br>DTPEKLRTLL AEKLSSRPEA VHKYVTPLFI SRAPNRKMSG QGHMVKSAKR<br>LDEGISVLRV PLTQLKLKDL EKMVNREREP KLYEALKARL EAHKDDPAKA<br>FAEPFYKYDK AGNRTQQVKA VRVEQVQKTG VWHHNGIA DNATIVRVDV<br>FEKGGKYYLV PIYSWQVAKG ILPDRAVVQG KDEEDWTVMD DSFEFKFVLY<br>ANDLIKLTAK KNEFLGYFVS LNRATGAIDI RTHDTDSTKG KNGIFQSVGV<br>KTALSFQKYQ IDELGKEIRP CRLKKRPPVR |
| *Campylobacter lari* Cas9 BAK69486.1 (SEQ ID NO. 9) | MRILGFDIGI NSIGWAFVEN DELKDCGVRI FTKAENPKNK ESLALPRRNA<br>RSSRRRLKRR KARLIAIKRI LAKELKLNYK DYVAADGELP KAYEGSLASV<br>YELRYKALTQ NLETKDLARV ILHIAKHRGY MNKNEKKSND AKKGKILSAL<br>KNNALKLENY QSVGEYFYKE FFQKYKKNTK NFIKIRNTKD NYNNCVLSSD<br>LEKELKLILE KQKEFGYNYS EDFINEILKV AFFQRPLKDF SHLVGACTFF<br>EEEKRACKNS YSAWEFVALT KIINEIKSLE KISGEIVPTQ TINEVLNLIL<br>DKGSITYKKF RSCINLHESI SFKSLKYDKE NAENAKLIDF RKLVEFKKAL<br>GVHSLSRQEL DQISTHITLI KDNVKLKTVL EKYNLSNEQI NNLLEIEFND<br>YINLSFKALG MILPLMREGK RYDEACEIAN LKPKTVDEKK DFLPAFCDSI<br>FAHELSNPVV NRAISEYRKV LNALLKKYGK VHKIHLELAR DVGLSKKARE<br>KIEKEQKENQ AVNAWALKEC ENIGLKASAK NILKLKLWKE QKEICIYSGN<br>KISIEHLKDE KALEVDHIYP YSRSFDDSFI NKVLVFTKEN QEKLNKTPFE<br>AFGKNIEKWS KIQTLAQNLP YKKKNILDE NFKDKQQEDF ISRNLNDTRY<br>IATLIAKYTK EYLNFLLLSE NENANLKSGE KGSKIHVQTI SGMLTSVLRH<br>TWGFDKKDRN NHLHHALDAI IVAYSTNSII KAFSDFRKNQ ELLKARFYAK<br>ELTSDNYKHQ VKFFEPPKSF REKILSKIDE IFVSKPPRKR ARRALHKDTF<br>HSENKIIDKC SYNSKEGLQI ALSCGRVRKI GTKYVENDTI VRVDIFKKQN<br>KFYAIPIYAM DFALGILPNK IVITGKDKNN NPKQWQTIDE SYEFCFSLYK<br>NDLILLQKKN MQEPEFAYYN DFSISTSSIC VEKHDNKFEN LTSNQKLLFS<br>NAKEGSVKVE SLGIQNLKVF EKYIITPLGD KIKADFQPRE NISLKTSKKY GLR |

TABLE 3

| C2c1 orthologs | |
|---|---|
| *Alicyclobacillus macrosporangiidus* strain DSM 17980 (SEQ ID NO. 10) | MVAVKSIKVKLMLGHLPEIREGLWHLHEAVNLGVRYYTEWLALLRQGNLYRRGKDGA<br>QECYMTAEQCRQELLVRLRDRQKRNGHTGDPGTDEELLGVARRLYELLVPQSVGKKGQ<br>AQMLASGELSPLADPKSEGGKGTSKSGRKPAWMGMKEAGDSRWVEAKARYEANKAKD<br>PTKQVIASLEMYGLRPLFDVFTETYKTIRWMPLGKHQGVRAWDRDMFQQSLERLMSWE<br>SWNERVGAEFARLVDRRDRFREKHFTGQEHLVALAQRLEQEMKEASPGFESKSSQAHRI<br>TKRALRGADGIIDDWLKLSEGEPVDRFDEILRKRQAQNPRRFGSHDLFLKLAEPVFQPLW<br>REDPSFLSRWASYNEVLNKLEDAKQFATFTLPSPCSNPVWARFENAEGTNIFKYDFLFDH<br>FGKGRHGVRFQRMIVMRDGVPTEVEGIVVPIAPSRQLDALAPNDAASPIDVFVGDPAAPG |

TABLE 3-continued

| C2c1 orthologs | |
|---|---|
| | AFRGQFGGAKIQYRRSALVRKGRREEKAYLCGFRLPSQRRTGTPADDAGEVFLNLSLRV<br>ESQSEQAGRRNPPYAAVFHISDQTRRVIVRYGEIERYLAEHPDTGIPGSRGLTSGLRVMSV<br>DLGLRTSAAISVFRVAHRDELTPDAHGRQPFFFPIHGMDHLVALHERSHLIRLPGETESKK<br>VRSIREQRLDRLNRLRSQMASLRLLVRTGVLDEQKRDRNWERLQSSMERGGERMPSDW<br>WDLFQAQVRYLAQHRDASGEAWGRMVQAAVRTLWRQLAKQVRDWRKEVRRNADKV<br>KIRGIARDVPGGHSLAQLDYLERQYRFLRSWSAFSVQAGQVVRAERDSRFAVALREHID<br>NGKKDRLKKLADRILMEALGYVYVTDGRRAGQWQAVYPPCQLVLLEELSEYRFSNDRP<br>PSENSQLMVWSHRGVLEELIHQAVHDVLVGTIPAAFSSRFDARTGAPGIRCRRVPSIPLK<br>DAPSIPIWLSHYLKQTERDAAALRPGELIPTGDGEFLVTPAGRGASGVRVVHADINAAHN<br>LQRRLWENFDLSDIRVRCDRREGKDGTVVLIPRLTNQRVKERYSGVIFTSEDGVSFTVGD<br>AKTRRRSSASQGEGDDLSDEEQELLAEADDARERSVVLFRDPSGFVNGGRWTAQRAFW<br>GMVHNRIETLLAERFSVSGAAEKVRG |
| *Bacillus hisashii*<br>strain<br>(SEQ ID NO. 11) | MATRSFILKIEPNEEVKKGLWKTHEVLNHGIAYYMNILKLIRQEAIYEHHEQDPKNPKKV<br>C4SKAEIQAELWDEVLKMQKCNSFTHEVDKDEVFNILRELYEELVPSSVEKKGEANQLSNKF<br>LYPLVDPNSQSGKGTASSGRKPRWYNLKIAGDPSWEEEKKKWEEDKKKDPLAKILGKLA<br>EYGLIPLFIPYTDSNEPIVKEIKWMEKSRNQSVRRLDKDMFIQALERFLSWESWNLKVKEE<br>YEKVEKEYKTLEERIKEDIQALKALEQYEKERQEQLLRDTLNTNEYRLSKRGLRGWREII<br>QKWLKMDENEPSEKYLEVFKDYQRKHPREAGDYSVYEFLSKKENHFIWRNHPEYPYLY<br>ATFCEIDKKKKDAKQQATFTLADPINHPLWVRFEERSGSNLNKYRILTEQLHTEKLKKKL<br>TVQLDRLIYPTESGGWEEKGKVDIVLLPSRQFYNQIFLDIEEKGKHAFTYKDESIKPPLKG<br>TLGGARVQFDRDHLRRYPHKVESGNVGRIYFNMTVNIEPTESPVSKSLKIHRDDFPKVVN<br>FKPKELTEWIKDSKGKKLKSGIESLEIGLRVMSIDLGQRQAAAASIFEVVDQKPDIEGKLF<br>FPIKGTELYAVHRASFNIKLPGETLVKSREVLRKAREDNLKLMNQKLNFLRNVLHFQQFE<br>DITEREKRVTKWISRQENSDVPLVYQDELIQIRELMYKPYKDWVAELKQLHKRLEVEIGK<br>EVKHWRKSLSDGRKGLYGISLKNIDEIDRTRKFLLRWSLRPTEPGEVRRLEPGQRFAIDQL<br>NHLNALKEDRLKKMANTIIMHALGYCYDVRKKKWQAKNPACQIILFEDLSNYNPYEERS<br>RFENSKLMKWSRREIPRQVALQGEIYGLQVGEVGAQFSSRFHAKTGSPGIRCSVVTKEKL<br>QDNRFFKNLQREGRLTLDKIAVLKEGDLYPDKGGEKFISLSKDRKCVTTHADINAAQNL<br>QKRFWTRTHGFYKVYCKAYQVDGQTVYIPESKDQKQKIIEEFGEGYFILKDGVYEWVNA<br>GKLKIKKGSSKQSSSELVDSDILKDSFDLASELKGEKLMLYRDPSGNVFPSDKWMAAGV<br>FFGKLERILISKLTNQYSISTIEDDSSKQSM |
| *Candidatus<br>Lindowbacteria<br>bacterium*<br>RIFCSPLOWO2<br>(SEQ ID NO. 12) | MPRDDLDLLTNLNSTAKGIRERGKTKEGTDKKKSGRKSSWPMDKAAWETAKTSDSSAH<br>FLEKLKQHPDLKDAFGNLSSGGSKKLEYYKKLAGSAPWKESQSVILEKAARWKEAKQE<br>REEKEQDSSEHGSKAAYRRLFDAGCLPMPEFAKYIDENQIEFGDLKLSDCGAEWKRGM<br>WNQAGQRVRSHMGWQRRREKENAVYSLRKELFEKGGAIRRKKSEELTPEDILPGKAAP<br>DQNDWQERPAYGNQMWFIGLRSYEENEMAKYAEEAGMGSRSAPRIRRGTIKGWSKLRE<br>RWLQILKRNPQATRDDLIGELNALRSQDPRAYGDARLFDWLSKTDQRFLWDGEDADGKI<br>LCGRDDRDCVSAFVAYNEEFADEPSSITLTETDERLHPVWPPFGESSAVPYEIEYDLETAC<br>PTAIRLPLLVGKENGGYAERQGTRLPLAEYADLASSFQLPTPVRLDVLVEIREVTRAGRK<br>VTCPFSYFKQNGVWYVREGEIPSGESIQIKQTDRKIENGKIFISSKLRMAYRDDLMVSPAT<br>GDFGSIKILWERIELASHVDQKKLPETAPARSRVFVSFSCNVVERAPRKQLTRKPDAVVV<br>TIPSGVDQGLVVVSTDVRTGKSKSSSAPPLPPGSRLWPADAVHGDPPLRILSVDLGHRHS<br>AYAVWELGLQQKSWRAGVLKGSTQTPVYADCTGTGLLCLPGDGEDTPAEEESLRLRSR<br>QIRRRLNLQNSILRVSRLLSLDKFEKTIFEQSDVRDRPNKKGLRIRRRCRTEKTPLSEAEVR<br>KNCDCKAAEILIRWADTDAMAKSLAATGNADISFWKYMAVKNPPLSAVVDVAPSTIVPD<br>DGPDRETLKKKRQEEEEKFASSIYENRVKLAGALCSGYDADHRRPATGGLWHDLDRTLI<br>REISYGDRGQKGNPRKLNNEGILRLLRRPPRARPDWREFHRTLNDANRIPKGRTLRGGLS<br>MGRLNFLKEVGDFVKKWSCRPRWPGDRRHIPPGQLFDRQDAEHLEHLRDDRIKRLAHLI<br>VAQALGFEPDIRRGLWKYVDGSTGEILWQHPETRRFFAEGAAGELREVSRPAEIDDDAA<br>ARPHTVSAPAHIVVFENLIRYRFQSDRPKTENAGLMQWAHRQIVHFTKQVASLYGLKVA<br>MVYAAFSSKFCSRCGSPGARVSRFDPAWRNQEWFKRRTSNPRSKVDHSLKRASEDPTAD<br>ETRPWVLIEGGKEFVCANAKCSAHDEPLNADENAAANIGLRFLRGVEDFRTKVNPAGAL<br>KGKLRFETGIHSFRPPVSGSPFWSPMAEPAQKKKIGAAAPGADVDEAGDADESGVVVLF<br>RDPSGAFRNKQYWYEGKIFWSNVMMAVEAKIAGASVGAKPVAASWGQAQPQSGPGLA<br>KPGGD |
| *Elusimicrobia<br>bacterium*<br>RIFOXYA12<br>(SEQ ID NO. 13) | MNRIYQGRVTKVEVPDGKDEKGNIKWKKLENWSDILWQHHMLFQDAVNYYTLALAAI<br>SGSAVGSDEKSIILREWAVQVQNIWEKAKKKATVFEGPQKRLTSILGLEQNASFDIAAKHI<br>LRTSEAKPEQRASALIRLLEEIDKKNHNVVCGERLPFFCPRNIQSKRSPTSKAVSSVQEQK<br>RQEEVRRFHNMQPEEVVKNAVTLDISLFKSSPKIVFLEDPKKARAELLKQFDNACKKHKE<br>LVGIKKAFTESIDKHGSSLKVPAPGSKPSGLYPSAIVFKYFPVDITKTVFLKATEKLAMGK<br>DREVTNDPIADARVNDKPHFDYFTNIALIREKEKNRAAWFEFDLAAFIEAIMSPHRFYQD<br>TQKRKEAARKLEEKIKAIEGKGGQFKESDSEDDDVDSLPGFEGDTRIDLLRKLVTDTLGW<br>LGESETPDNNEGKKTEYSISERTLRIFPDIQKQWSELAEKGETTEGKLLEVLKHEQTEHQS<br>DFGSATLYQHLAKPEFHPIWLKSGTEEWHAENPLKAWLNYKELQYELTDKKRPIHFTPA<br>HPVYSPRYFDFPKKSETEEKEVSKNTHSLTTSLASEHIKNSLQFTAGLIRKTNVGKKAIKA<br>RFSYSAPRLRRDCLRSENNENLYKAPWLQPMMRALGIDEEKADRQNFANTRITLMAKGL<br>DDIQLGFPVEANSQELQKEVSNGISWKGQFNWGGIASLSALRWPHEKKPKNPPEQPWWG<br>IDSFSCLAVDLGQRYAGAFARLDVSTIEKKGKSRFIGEACDKKWYAKVSRMGLLRLPGE<br>DVKVWRDASKIDKENGFAFRKELFGEKGRSATPLEAEETAELIKLFGANEKDVMPDNWS<br>KELSFPEQNDKLLIVARRAQAAVSRLHRWAWPFFDEAKRSDDAIREILESDDTDLKQKVN<br>KNEIEKVKETIISLLKVKQELLPTLLTRLANRVLPLRGRSWEWKKHHQKNDGFILDQTGK<br>AMPNVLIRGQRGLSMDRIEQITELRKRFQALNQSLRRQIGKKAPAKRDDSIPDCCPDLLEK<br>LDHMKEQRVNQTAHMILAEALGLKLAEPPKDKKELNETCDMHGAYAKVDNPVSFIVIE<br>DLSRYRSSQGRSPRENSRLMKWCHRAVRDKLKEMCEVFFPLCERRKAGSAWVSLPPLLE<br>TPAAYSSRFCSRSGVAGFRAVEVIPGFELKYPWSLKDKKDKAGNLAKEALNIRTVSEQ |

TABLE 3-continued

C2c1 orthologs

|  |  |
|---|---|
|  | LKAFNQDKPEKPRTLLVPIAGGPIFVPISEVGLSSFGLKPQVVQADINAAINLGLRAISDPRI<br>WEIHPRLRTEKRDGRLFAREKRKYGEEKVEVQPSKNEKAKKVKDDRKPNYFADFSGKV<br>DWGFGNIKNESGLTLVSGKALWWTINQLQWERCFDINKRHIEDWSNKQKQ |
| *Omnitrophica* WOR_2<br>bacterium<br>RIFCSPHIGHO2<br>(SEQ ID NO. 14) | MNRIYQGRVTKVEKLKNGKSPDDREELKDWQTALWRHHELFQDAVSYYTLALAAMAE<br>GLPDKHPINVLRKRMEEAWEEFPRKTVTPAKNLRDSVRPWLGLSESASFGDALKKILPPA<br>PENKEVRALAVALLAEKARTLKPQKTSASYWGRFCDDLKKKPNWDYSEEELARKTGSG<br>DWVAGLWSEDALNKIDELAKSLKLSSLVKCVPDGQINPEGARNLVKEALDHLEGVSNGT<br>KKEKNDPGPAKKTNNWLRQHASDVRNFIHKNKNQFSSLPNGRLITERARGGGININKTY<br>AGVLFKAFPCPFTFDYVRAAVPEPKVKKVDQEKKSEQSATWTELEKRILRIGDDPIELAR<br>KNNKPIFKAFTALEKWSDQNSKSCWSDFDKCAFEEALKTLNQFNQKTEEREKRRSEAEA<br>ELKYMMDENPEWKPKKETEGDDVREVPILKGDPRYEKLVKLFGDLDEEGSEHATGKIYG<br>PSRASLRGFGKLRNEWVDLFTKANDNPREQDLQKAVTGFQREHKLDMGYTAFFLKLCE<br>RDYWDIWRDDTEVEVKKIREKRWVKSVVYAAADTRELAEEELERLQEPVRYTPAEPQFSR<br>RLFMFSDIKGKQGAKHIREGLVEVSLAVKDQSGKYGTCRVRLHYSAPRLIRDHLSDGSSS<br>MWLQPMMAALGLSSDARGCFTRDSKGNVKEPAVALMSDFVGRKRELRMLLNFPVDLDI<br>SKLEENIGKKARWEKQMNTAYEKNKLKQRFHLIWPGMELKETQEPGQFWWDNPTIQKE<br>GMYCLAIDLSQRRAADYALLHAGVNRDSKTFVELGQAGGQSWFTKLCAAGSLRLPGED<br>TEVIREGKRQIELSGKKGRNATQSEYDQAIALAKQLLHNENSAELESAARDWLGDNAKR<br>FSFPEQNDKLIDLYYGALSRYKTWLRWSWRLTEQHKELWDKTLDEIRKVPYFASWGEL<br>AGNGTNEATVQQLQKLIADAAVDLRNFLEKALLHIAYRALPLRENTWRWIENGKDGKK<br>KPLHLLVSDGQSPAEIPWLRGQRGLSIARIEQLENFRRAVLSLNRLLRHEIGTKPEFGSSTC<br>GESLPDDPCPDLTDKIVRLKEERVNQTAHLIIAQSLGVRLKGHSLFTEEREKADMHGEHEVI<br>PGRSPVDFVVLEDLSRYTTDKSRSRSENSRLMKWCHRKINEKVKLLAEPFGIPVIEVFASY<br>SSKFDARTGAPGFRAVEVTSEDRPFWRKTIEKQSVAREVFDCLDNLVGKGLNGIHLVLPQ<br>NGGPLFIAAVKEDQPLPAIRQADINAAVNIGLRAIAGPSCYHAHPKVRLIKGESGTDKGK<br>WLPRKGKEANKRENAQFGNVDLDLEVKFNRLDIDSDVLKGDNTNLFHDPLNIACYGFAT<br>IQNLQHPFLAHASAVFSRQKGAVARLQWEVCRAINSRRLEAWQKKAEKAAVKR |
| *Phycisphaerae*<br>bacterium ST-<br>NAGAB-D1<br>(SEQ ID NO. 15) | MATKSYRARILTDSRLAAALDRTHVVFVESLKQMINTYLRMQNGKFGPDHKKLAQIMLS<br>RSNTFAHGVMDQITRDQPTSTLDEEWTDLARRIHKTTGPLFLQAERFATVKNRAIHTKSR<br>GKVIPSPETLAVPAKFWHQVCDSASAYIRSNRELMQQWRKDRAAWLKDKNEWQQKHP<br>EFMQFYNGPYQNFLKLCDDDRITSQLAAEQQPTASKNNRPRKTGKRFARWHLWYKWLS<br>ENPEIIEWRNKASASDFKTVTDDVRKQIITKYPQQNKYITRLLDWLEDNNPELKTLENLRR<br>TYVKKFDSFKRPPTLTLPSPYRHPYWPTMELDQFYKKADFENGTIQLLLIDEDDDGNWFF<br>NWMPASLKPDPRLVPSWRAETFETEGRFPPYLGGKIGKKLSRPAPTDAERKAGIAGAKL<br>MIKNNRSELLFTVFEQDCPPRVKWAKTKNRKCPADNAFSSDGKTRKPLRILSIDLGIRHIG<br>AFALTQGTRNDSAWQTESLKKGIINSPSIPPLRQVRRHDYDLKRKRRRHGKPVKGQRSNA<br>NLQAHRTNMAQDRFKKGASAIVSLAREHSADLILFENLHSLKFSAFDERWMNRQLRDM<br>NRRHIVELVSEQAPEFGITVKDDINPWMTSRICSNCNLPGPFRFSMKKKNPYREKLPREKCT<br>DFGYPVWEPGGHLFRCPHCDHRVNADINAAANLANKFFGLGYWNNGLKYDAETKTFTV<br>HTDKKTPPLIFKPRPQFDLWADSVKTRKQLGPDPF |
| *Planctomycetes*<br>bacterium<br>RBG_13_46_10<br>(SEQ ID NO. 16) | MSVRSFQARVECDKQTMEHLWRTHKVFNERLPEIIKILFKMKRGECGQNDKQKSLYKSIS<br>QSILEANAQNADYLLNSVSIKGWKPGTAKKYRNASFTWADDAAKLSSQGIHVYDKKQV<br>LGDLPGMMSQMVCRQSVEAISGHIELTKKWEKEHNEWLKEKEKWESEDEHKKYLDLRE<br>KFEQFEQSIGGKITKRRGRWHLYLKWLSDNPDFAAWRGNKAVINPLSEKAQIRINKAKPN<br>KKNSVERDEFFKANPEMKALDNLHGYYERNFVRRRKTKKNPDGFDHKPTFTLPHPTIHP<br>RWFVFNKPKTNPEGYRKLILPKKAGDLGSLEMRLLTGEKNKGNYPDDWISVKFKADPRL<br>SLIRPVKGRRVVRKGKEQGQTKETDSYEFFDKHLKKWRPAKLSGVKLIFPDKTPKAAYL<br>YFTCDIPDEPLTETAKKIQWLETGDVTKKGKKRKKKVLPHGLVSCAVDLSMRRGTTGFA<br>TLCRYENGKIHILRSRNLWVGYKEGKGCHPYRWTEGPDLGHIAKHKREIRILRSKRGKPV<br>KGEESHIDLQKHIDYMGEDRFKKAARTIVNFALNTENAASKNGFYPRADVLLLENLEGLI<br>PDAEKERGINRALAGWNRRHLVERVIEMAKDAGFKRRVFEIPPYGTSQVCSKCGALGRR<br>YSIIRENNRREIRFGYVEKLFACPNCGYCANADHNASVNLNRRFLIEDSFKSYYDWKRLS<br>EKKQKEEIETIESKLMDKLCAMHKISRGSISK |
| *Spirochaetes*<br>bacterium<br>GWB1_27_13<br>(SEQ ID NO. 17) | MSFTISYPFKLIIKNKDEAKALLDTHQYMNEGVKYYLEKLLMFRQEKIFIGEDETGKRIYI<br>EETEYKKQIEEFYLIKKTELGRNLTLTLDEFKTLMRELYICLVSSSMENKKGFPNAQQASL<br>NIFSPLFDAESKGYILKEENNNISLIHKDYGKILLKRLRDNNLIPIFTKFTDIKKITAKLSPTA<br>LDRMIFAQAIEKLLSYESWCKLMIKERFDKEVKIKELENKCENKQERDKIFEILEKYEEER<br>QKTFEQDSGFAKKGKFYITGRMLKGFDEIKEKWLKEKDRSEQNLINILNKYQTDNSKLV<br>GDRNLFEFIIKLENQCLWNGDIDYLKIKRDINKNQIWLDRPEMPRFTMPDFKKHPLWYRY<br>EDPSNSNFRNYKIEVVKDENYITIPLITERNNEYFEENYTFNLAKLKKLSENITFIPKSKNKE<br>FEFIDSNDEEEDKKDQKKSKQYIKYCDTAKNTSYGKSGGIRLYFNRNELENYKDGKKMD<br>SYTVFTLSIRDYKSLFAKEKLQPQITNTVDNKITSLKIQKKFGNEEQTNFLSYFTQNQITKK<br>DWMDEKTFQNVKELNEGIRVLSVDLGQRFFAAVSCFEIMSEIDNNKLFFNLNDQNHKIIRI<br>NDKNYYAKHIYSKTIKLSGEDDDLYKERKINKNYKLSYQERKNKIGIFTRQINKLNQLLKI<br>IRNDEIDKEKFKELIETTKRYVKNTYNDGIIDWNNVDNKILSYENKEDVINLHKELDKKLE<br>IDFKEFIRECRKPIFRSGGLSMQRIDFLEKLNKLRKWVARTQKSAESIVLTPKFGYKLKE<br>HINELKDNRVKQGVNYILMTALGYIKDNEIKNDSKKKQKEDWVKKNRACQIILMEKLTE<br>YTFAEDRPREENSKLRMWSHRQIFNFLQQKASLWGILVGDVFAPYTSKCLSDNNAPGIRC<br>HQVTKKDLIDNSWFLKIVVKDDAFCDLIEINKENVKNKSIKINDILPLRGGELFASIKDGKL<br>HIVQADINASRNIAKRFLSQINPFRVVLKDKDETFHLKNEPNYLKNYYSILNFVPTNEEL<br>TFFKVEENKDIKPTKRIKMDKHEKESTDEGDDYSKNQIALFRDDSGIFFDKSLWVDGKIF<br>WSVVKNKMTKLLRERNNKKNGSK |

TABLE 3-continued

| C2c1 orthologs |  |
|---|---|
| Verrucomicrobiaceae bacterium UBA2429 (SEQ ID NO. 18) | MPLSRIYQGRTNSLIILTPTPQEPWDHKALARFDSPLWRHHALFQDAVNYYQLCLVALAS SDGTRPLSKLHEQMKASWDEAKTDTEDSWRVRLARRLGIPAASLFEAALAKVLEGNEAP ERARELAGELLLDKIEGDIQQAGRGYWPRFCDPKANPTYDYSATARASASGLTKLAAVI HAENVTEEALKQVAAEMDLSWTVKLQPDKNFVGAEARARLLEAAHHFIKVAESPPTKL AEVLARFPDGLALWQALPEKIAALPEETQVPRNRKASPDLTFATLLFQHFPSLFTAAVLG LSVGKPKSVKAPKVVEKVSARRKANAVTQAVVIEEPEIDFAELGDDPIKLARGERGFVP AFTSLSFWAVPGPHVPVWKEFDIAAFKEALKTVNQFKLKTSERNALLAEAQRRLDYMDE KTHDWKTGDSDEPGHIPPRLKSDPNFTLIQALTQDEGVSNKATGDQHIPKGVYTGGLRGF YAIKKDWCELWERKADKSQGTPTEEELISIVTDYQRDHVYDVGDVGLFRALCEPRFWPL WQPLTDEQEAERIKAGRAKDMISAYRVWLELQEDVVRLAQPIRFTPAHAENSRRLFMFS DISGSHGAEFGSDGKSLEVSIAYDVDGKLQPVRAKLEFSAPRAARDELEGLSGGSESMRW FQPMMKALDCPEVEMPALEKCAVSLMPDVVKKGGGKWVRLLLNFPATLEPEGLIRHIG KQAMWYKQFNGTYKPRTQQLDTGLHLYWPGLEKAPEAEDAAAWWNREEIRAKGFSVL SVDLGQRDAGAWALLESRSDKAFSRNRQPFIELGEAGGKLWSTALLGLGMLRLPGEDAR TGALDDQGKRAVEFHGKAGRNALEAEWQEAREMALLFGGEEAKSRLGPGFDHLSHSKQ NEELLRILSRAQSRLARFHRWSCRIHEKPEATGDDVIDYGQVDELLTKTAEAMLENLKAL YTNAGGILDSKSKQPLTLVGLRKKLEAQKVEPEKIAAVLKPHAEIIFQRLGTLIPELKQHL RVSLERLANRELPLRHREWVWNEAFEKLEQGNFKKEENPKWIRGQRGLSMARIEQIENL RKRFMSLRRQMSLIPGEQVKGQVEDKGQRQPEPCEDILNKLDRMKQQRVNQTAHLILAQ ALGLRLRPHLANDAEREEKDIHGEYELIPGRKPVDFIVMEDLSRYLSSQGRAPSENGRLM KWCHRAVLAKLKQMCEPPFGIPVLEVPAAYSSRFCALTGVPGFRAVEVHDGNAEDFRWK RLIKKAEKDKSSKDAEAAAMLFDQLHDLNIEAREARKQDKKLPLRTLFAPVAGGPLFIPM VGGGPRQADMNAAINLGLRAIASPTCLRARPKIRAELKDGKHQAMLGNKLEKAAALTLE PPKEPTKELAAQKRTNFFLDEKFVGKFDTAHVTTSGKKLRLSGGMSLWKAIKDGAWQR VKKINDARIAKWKNNPPPEPDPDDEIQF |
| Alicyclobacillus kakegawensis (SEQ ID NO. 19) | MAVKSIKVKLRLSECPDILAGMWQLHRATNAGVRYYTEWVSLMRQEILYSRGPDGGQQ CYMTAEDCQRELLRRLRNRQLHNGRQDQPGTDADLLAISRRLYEILVLQSIGKRGDAQQI ASSFLSPLVDPNSKGGRGEAKSGRKPAWQKMRDQGDPRWVAAREKYEQRKAVDPSKEI LNSLDALGLRPLFAVFTETYRSGVDWKPLGKSQGVRTWDRDMFQQALERLMSWESWN RRVGEEYARLFQQKMKFEQEHFAEQSHLVKLARALEADMRAASQGFEAKRGTAHQITR RALRGADRVFEIWKSIPEEALFSQYDEVIRQVQAEKRRDFGSHDLFAKLAEPKYQPLWRA DETFLTRYALYNGVLRDLEKARQFATFTLPDACVNPIWTRFESSQGSNLHKYEFLFDHLG PGRHAVRFQRLLVVESEGAKERDSVVVPVAPSGQLDKLVLREEEKSSVALHLHDTARPD GFMAEWAGAKLQYERSTLARKARRDKQGMRSWRRQPSMLMSAAQMLEDAKQAGDV YLNISVRVKSPSEVRGQRRPPYAALFRIDDKQRRVTVNYNKLSAYLEEHPDKQIPGAPGL LSGLRVMSVDLGLRTSASISVFRVAKKEEVEALGDGRPPHYYPIHGTDDLVAVHERSHLI QMPGETETKQLRKLREERQAVLRPLFAQLALLRLLVRCGAADERIRTRSWQRLTKQGRE FTKRLTPSWREALELELTRLEAYCGRVPDDEWSRIVDRTVIALWRRMGKQVRDWRKQV KSGAKVKVKGYQLDVVGGNSLAQIDYLEQQYKFLRRWSFFARASGLVVRADRESHFAV ALRQHIENAKRDRLKKLADRILMEALGYVYEASGPREGQWTAQHPPCQLIILEELSAYRF SDDRPPSENSKLMAWGHRGILEELVNQAQVHDVLVGTVYAAFSSRFDARTGAPGVRCR RVPARFVGATVDDSLPLWLTEFLDKHRLDKNLLRPDDVIPTGEGEFLVSPCGEEAARVRQ VHADINAAQNLQRRLWQNFDITELRLRCDVKMGGEGTVLVWQNVPRVNNARAKQLFGKKVLV SQDGVTFFERSQTGGKPHSEKQTDLTDKELELIAEADEARAKSVVLFRDPSGHIGKGHWI RQREFWSLVKQRIESHTAERIRVRGVGSSLD |
| Bacillus sp._V3-13 (SEQ ID NO. 20) | MAIRSIKLKMKTNSGTDSIYLRKALWRTHQLINEGIAYYMNLLTLYRQEAIGDKTKEAYQ AELINIIRNQQRNNGSSEEHGSDQEILALLRQLYELIIPSSIGESGDANQLGNKFLYPLVDPN SQSGKGTSNAGRKPRWKRLKEEGNPDWELEKKKDEERKAKDPTVKIFDNLNKYGLLPLF PLFTNIQKDIEWLPLGKRQSVRKWDKDMFIQAIERLLSWESWNRRVADEYKQLKEKTES YYKEHLTGGEEWIEKIRKFEKERNMELEKNAFAPNDGYFITSRQIRGWDRVYEKWSKLP ESASPEELWKVVAEQQNKMSEGFGDPKVFSFLANRENRDIWRGHSERIYHIAAYNGLQK KLSRTKEQATFTLPDAIEHPLWIRYESPGGTNLNLFKLEEKQKKNYYVTLSKIIWPSEEKW IEKENIEIPLAPSIQFNRQIKLKQHVKGKQEISFSDYSSRISLDGVLGGSRIQFNRKYIKNHK ELLGEGDIGPVFFNLVVDVAPLQETRNGRLQSPIGKALKVISSDFSKVIDYKPKELMDWM NTGSASNSFGVASLLEGMRVMSIDMGQRTSASVSIFEVVKELPKDQEQKLFYSINDTELF AIHKRSFLLNLPGEVVTKNNKQQRQERRKKRQFVRSQIRMLANVLRLETKKTPDERKKAI HKLMEIVQSYDSWTASQKEVWEKELNLLTNMAAFNDEIWKESLVELHHRIEPYVGQIVS KWRKGLSEGRKNLAGISMWNIDELEDTRRLLISWSKRSRTPGEANRIETDEPFGSSLLQHI QNVKDDRLKQMANLIIMTALGFKYDKEEKDRYKRWKETYPACQIILFENLNRYLFNLDR SRRENSRLMKWAHRSIPRTVSMQGEMFGLQVGDVRSEYSSRFHAKTGAPGIRCHALTEE DLKAGSNTLKRLIEDGFINESELAYLKKGDIIPSQGGELFVTLSKRYKKDSDNNELTVIHA DINAAQNLQKRFWQQNSEVYRVPCQLARMGEDKLYIPKSQTETIKKYFGKGSFVKNNTE QEVYKWEKSEKMKIKTDTTFDLQDLDGFEDISKTIELAQEQQKKYLTMFRDPSGYFFNNE TWRPQKEYWSIVNNIIKSCLKKKILSNKVEL |
| Desulfatirhabdium butyrativorans (SEQ ID NO. 21) | MPLSNNPPVTQRAYTLRLRGADPSDLSWREALWHTHEAVNKGAKVFGDWLLTLRGGL DHTLADTKVKGGKGPKDRDPTPEERKARRILLALSWLSVESKLGAPSSYIVASGDEPAKD RNDNVVSALEEILQSRKVAKSEIDDWKRDCSASLSAAIRDDAVWVNRSKVFDEAVKSVG SSLTREEAWDMLERFFGSRDAYLTPMKDPEDKSSETEQEDKAKDLVQKAGQWLSSRYG TSEGADFCRMSDIYGKIAAWADNASQGGSSTVDDLVSELRQHFDTKESKATNGLDWIIG LSSYTGHTPNPVHELLRQNTSLNKSHLDDLKKKANTRAESCKSKIGSKGQRPYSDAILND VESVCGFTYRVDKDGQPVSVADYSKYDVDYKWGTARHYIFAVMLDHAARRISLAHKWI KRAEAERHKFEEDAKRIANVPARAREWLDSFCKERSVTSGAVEPYRIRRRAVDGWKEVV AAWSKSDCKSTEDRIAAARALQDDSEIDKFGDIQLFEALAEDDALCVWHKDGEATNEPD FQPPLIDYSLAIEEAEFKKRQFKVPAYRHPDELLHPVFCDFGKSRWKINYDVHKNVQAPFYR GLCLTLWTGSEIKPVPLCWQSKRLTRDLALGNNHRNDAASAVTRADRLGRAASNVTKS |

TABLE 3-continued

C2c1 orthologs

|  |  |
|---|---|
|  | DMVNITGLFEQADWNGRLQAPRQQLEAIAVVRDNPRLSEQERNLRMCGMIEHIRWLVTF<br>SVKLQPQGPWCAYAEQHGLNTNPQYWPHADTNRDRKVHARLILPRLPGLRVLSVDLGH<br>RYAAACAVWEAVNTETVKEACQNVGRDMPKEHDLYLHIKVKKQGIGKQTEVDKTTIYR<br>RIGADTLPDGRPHPAPWARLDRQFLIKLQGEEKDAREASNEEIWALHQMECKLDRTKPLI<br>DRLIASGWGLLKRQMARLDALKELGWIPAPDSSENLSREDGEAKDYRESLAVDDLMFSA<br>VRTLRLALQRHGNRARIAYYLISEVKIRPGGIQEKLDENGRIDLLQDALALWHELFSSPG<br>WRDEAAKQLWDSRIATLAGYKAPEENGDNVSDVAYRKKQQVYREQLRNVAKTLSGDV<br>ITCKELSDAWKERWEDEDQRWKKLLRWFKDWVLPSGTQANNATIRNVGGLSLSRLATI<br>TEFRRKVQVGFFTRLRPDGTRHEIGEQFGQKTLDALELLREQRVKQLASRIAEEAALGISE<br>GGKGWDGGKRPRQRINDSRFAPCHAVVIENLANYRPDETRTRLENRRLMTWSASKVHK<br>YLSEACQLNGLYLCTVSAWYTSRQDSRTGAPGIRCQDVSREFMQSPFWRKQVKQAEA<br>KHDENKGDARERFLCELNKTWKAKTPAEWKKAGFVRIPLRGGEIFVSADSKSPSAKGIH<br>ADLNAAANIGLRALTDPDWPGKWWYVPCDPVSFESKMDYVKGCAAVKVGQPLRQPAQ<br>TNADGAASKIRKGKKNRTAGTSKEKVYLWRDISAFPLESNEIGEWKETSAYQNDVQYRV<br>IRMLKEHIKSLDNRTGDNVEG |
| Desulfonatronum<br>thiodismutans<br>(SEQ ID NO. 22) | MVLGRKDDTAELRRALWTTHEHVNLAVAEVERVLLRCRGRSYWTLDRRGDPVHVPES<br>QVAEDALAMAREAQRRNGWPVVGEDEEILLALRYLYEQIVPSCLLDDLGKPLKGDAQKI<br>GTNYAGPLFDSDTCRRDEGKDVACCGPFHEVAGKYLGALPEWATPISKQEFDGKDASHL<br>RFKATGGDDAFFRVSIEKANAWYEDPANQDALKNKAYNKDDWKKEKDKGISSWAVKY<br>IQKQLQLGQDPRTEVRRKLWLELGLLPLFIPVFDKTMVGNLWNRLAVRLALAHLLSWES<br>WNHRAVQDQALARAKRDELAALFLGMEDGFAGLREYELRRNESIKQHAFEPVDRPYVV<br>SGRALRSWTRVREEWLRHGDTQESRKNICNRLQDRLRGKFGDPDVFHWLAEDGQEALW<br>KERDCVTSFSLLNDADGLLEKRKGYALMTFADARLHPRWAMYEAPGGSNLRTYQIRKT<br>ENGLWADVVLLSPRNESAAVEEKTFNVRLAPSGQLSNVSFDQIQKGSKMVGRCRYQSAN<br>QQFEGLLGGAEILFDRKRIANEQHGATDLASKPGHVWFKLTLDVRPQAPQGWLDGKGRP<br>ALPPEAKHFKTALSNKSKFADQVRPGLRVLSVDLGVRSFAACSVFELVRGGPDQGTYFP<br>AADGRTVDDPEKLWAKHERSFKITLPGENPSRKEEIARRAAMEELRSLNGDIRRLKAILR<br>LSVLQEDDPRTEHLRLFMEAIVDDPAKSALNAELFKGEGDDRERSTPDLWKQHCFFHD<br>KAEKVVAERFSRWRTETRPKSSSWQDWRERRGYAGGKSYWAVTYLEAVRGLILRWNM<br>RGRTYGEVNRQDKKQEGTVASALLHHINQLKEDRIKTGADMIIQAARGFVPRKNGAGW<br>VQVHEPCRLILFEDLARYRERTDRSRRENSRLMRWSHREIVNEVGMQGELYGLHVDTTE<br>AGFSSRYLASSGAPGVRCRHLVEEDFHDGLPGMHLVGELDWLLPKDKDRTANEARRLL<br>GGMVRPGMLVPWDGGELFATLNAASQLHVIHADINAAQNLQRRFWGRCGEAIRIVCNQ<br>LSVDGSTRYEMAKAPKARLLGALQQLKNGDAPHLTSIPNSQKPENSYVMTPTNAGKKY<br>RAGPGEKSSGEEDELALDIVEQAEELAQGRKTFFRDPSGVFFAPDRWLPSEIYWSRIRRRI<br>WQVTLERNSSGRQERAEMDEMPY |
| Lentisphaeria<br>bacterium<br>(SEQ ID NO. 23) | MAVELNRIYQGRVNHVYIFDENQNQVSVDNGDDLLFVHHELYQDAINYYLVALAAMAL<br>DSKDSLFGKFKMQIRAVWNDFYRNGPLRPGLKHSLIRSLGHAAELNTSNGADIAMNLILE<br>DGGIPSEILNAALEHLAEKCTGDVSQLGKTFFPRFCDTAYHGNWDVDAKSFSEKKGRQR<br>LVDALYSLHPVQAVQELAPEIEIGWGGVKTQTGKFFTGDEAKASLKKAISYFLQDTGKNS<br>PELQEYFSVAGKQPLEQYLGKIDTFPEISFGRISSHQNINISNAMWILKFFPDQYSVDLIKNL<br>IPNKKYEIGIAPQWGDDPVKLSRGKRGYTFRAFTDLAMWEKNWKVFDRAAFSDALKTIN<br>QFRNKTQERNDQLKRYCAALNWMDGESSDKKPPVEPADADAVDEAATSVLPILAGDKR<br>WNALLQLQKELGICNDFTENELMDYGLSLRTIRGYQKLRSMMLEKEEKMRAKTADDEEI<br>SQALQEIIIKFQSSHRDTIGSVSLFLKLAEPKYFCVWHDADKNQNFASVDMVADAVRYYS<br>YQEEKARLEEPIQITPADARYSRRVSDLYALVYKNAKECKTGYGLRPDGNFVFEIAQKNA<br>KGYAPAKVVLAFSAPRLKRDGLIDKEFSAYYPPVLQAFLREEEAPKQSEKTTAVILMPDW<br>DKNGKRRILLNFPPIKLDVSAIHQKTDHRFENQFYFANNTNTCLLWPSYQYKKPVTWYQG<br>KKPFDVVAVDLGQRSAGAVSRITVSTEKREHSVAIGEAGGTQWYAYRKFSGLLRLPGED<br>ATVIRDGQRTEELSGNAGRLSTEEETVQACVLCKMLIGDATLLGGSDEKTIRSFPKQNDK<br>LLIAFRRATGRMKQLQRWLWMLNENGLCDKAKTEISNSDWLVNKNIDNVLKEEKQHRE<br>MLPAILLQIADRVLPLRGRKWDWVLNPQSNSFVLQQTAHGSGDPHKKICGQRGLSFARIE<br>QLESLRMRCQALNRILMRKTGEKPATLAEMRNNPIPDCCPDILMRLDAMKEQRINQTAN<br>LILAQALGLRHCLHSESATKRKENGMHGEYEKIPGVEPAAFVVLEDLSRYRFSQDRSSYE<br>NSRLMKWSHRKILEKLALLCEVFNVPILQVGAAYSSKFSANAIPGFRAEECSIDQLSFYPW<br>RELKDSREKALVEQlRKIGHRLLTFDAKATIIMPRNGGPVFIPFVPSDSKDTLIQADINASF<br>NIGLRGVADATNLLCNNRVSCDRKKDCWQVKRSSNFSKMVYPEKLSLSFDPIKKQEGAG<br>GNFFVLGCSERILTGTSEKSPVFTSSEMAKKYPNLMFGSALWRNEILKLERCCKINQSRLD<br>KFIAKKEVQNEL |
| Laceyella<br>sediminis<br>(SEQ ID NO. 24) | MSIRSFKLKIKTKSGVNAEELRRGLWRTHQLINDGIAYYMNWLVLLRQEDLERNEETNE<br>IEKRSKEEIQGELLERVHKQQQRNQWSGEVDDQTLLQTLRHLYEEIVPSVIGKSGNASLK<br>ARFFLGPLVDPNNKTTKDVSKSGPTPKWKKMKDAGDPNWVQYEKYMAERQTLVRLE<br>EMGLIPLFPMYTDEVGDIHWLPQASGYTRTWDRDMFQQAIERLLSWESWNRRVRERRA<br>QFEKKTHDFASRFSESDVQWMNKLREYEAQQEKSLEENAFAPNEPYALTKKALRGWER<br>VYHSWMRLDSAASEEAYWQEVATCQTAMRGEFGDPAIYQFLAQKENHDIWRGYPERVI<br>DPAELNHLQRELRRAKEDATFTLPDSVDHPLWVRYEAPGGTNIHGYDLVQDTKRNLTLI<br>LDKFILPDENGSWHEVKKVPFSLAKSKQEHRQVWLQEEQKQKKREVVFYDYSTNLPHLG<br>TLAGAKLQWDRNFLNKRTQQQIEETGEIGKVFFNISVDVRPAVEVKNGRLQNGLGKALT<br>VLTHPDGTKIVTGWKAEQLEKWVGESGRVSSLGLDSLSEGLRVMSIDLGQRTSATVSVF<br>EITKEAPDNPYKFFYQLEGTELFAVHQRSFLLALPGENPPQKIKQMREIRWKERNRIKQQV<br>DQLSAILRLHKKVNEDERIQAIDKLLQKVASWQLNEEIATAWNQALSQLYSKAKENDLQ<br>WNQAIKNAHHQLEPVVGKQISLWRKDLSTGRQGIAGLSLWSIEELEATKKLLTRWSKRS<br>REPGVVKRIERFETFAKQIQHHINQVKENRLKQLANLIVMTALGYKDQEQKKWIEVYP<br>ACQVVLFENLRSYRFSYERSRRENKKLMEWSHRSIPKLVQMGELFGLQVADVYAAYSS<br>RYHGRTGAPGIRCHALTEADLRNETNIIHELIEAGFIKEEHRPYLQQGDLVPWSGGELFAT |

TABLE 3-continued

C2c1 orthologs

|  |  |
|---|---|
|  | LQKPYDNPRILTLHADINAAQNIQKRFWHPSMWFRVNCESVMEGEIVTYVPKNKTVHKK<br>QGKTFREVKVEGSDVYEWAKWSKNRNKNTFSSITERKPPSSMILFRDPSGTFFKEQEWVE<br>QKTFWGKVQSMIQAYMKKTIVQRMEE |
| Methylobacterium<br>nodulans<br>(long form)<br>(SEQ 1D NO. 25) | MYEAIVLADDANAQLANAFLGPLTDPNSAGFLEAFNKVDRPAPSWLDQVPASDPIDPAV<br>LAEANAWLDTDAGRAWLVDTGAPPRWRSLAAKQDPIWPREFARKLGELRKEAASGTSA<br>IIKALKRDFGVLPLFQPSLAPRILGSRSSLTPWDRLAFRLAVGHLLSWESWCTRARDEHTA<br>RVQRLEQFSSAHLKGDLATKVSTLREYERARKEQIAQLGLPMGERDFLITVRMTRGWDD<br>LREKWRRSGDKGQEALHAIIATEQTRKRGRFGDPDLFRWLARPENHHVwADGHADAVG<br>VLARVNAMERLVERSRDTALMTLPDPVAHPRSAQWEAEGGSNLRNYQLEAVGGELQIT<br>LPLLKAADDGRCIDTPLSFSLAPSDQLQGVVLTKQDKQQKITYCTNMNEVFEAKLGSADL<br>LLNWDHLRGRIRDRVDAGDIGSAFLKLALDVAHVLPDGVDDQLARAAFHFQSAKGAKS<br>KHADSVQAGLRVLSIDLGVRSFATCSVFELKDTAPTTGVAFPLAEFRLWAVHERSFTLEL<br>PGENVGAAGQQWRAQADAELRQLRGGLNRHRQLLRAATVQKGERDAYLTDLREAWSA<br>KELWPFEASLLSELERCSTVADPLWQDTCKRAARLYRTEFGAVVSEWRSRTRSREDRKY<br>AGKSMWSVQHLTDVRRFLQSWSLAGRASGDIRRLDRERGGVFAKDLLDHIDALKDDRL<br>KTGADLIVQAARGFQRNEFGYWVQKHAPCHVILFEDLSRYRMRTDRPRRENSQLMQWA<br>HRGVPDMVGMQGEIYGIQDRRDPDSARKHARQPLAAFCLDTPAAFSSRYHASTMTPGIR<br>CHPLRKREFEDQGFLELLKRENEGLDLNGYKPGDLVPLPGGEVFVCLNANGLSRIHADIN<br>AAQNLQRRFWTQHGDAFRLPCGKSAVQGQIRWAPLSMGKRQAGALGGFGYLEPTGHDS<br>GSCQWRKTTEAEWRRLSGAQKDRDEAAAAEDEELQGLEEELLERSGERVVFFRDPSGV<br>VLPTDLWFPSAAFWSIVRAKTVGRLRSHLDAQAEASYAVAAGL |
| Opitutaceae<br>bacterium<br>(SEQ ID NO. 26) | MSLNRIYQGRVAAVETGTALAKGNVEWMPAAGGDEVLWQHHELFQAAINYYLVALLA<br>LADKNNPVLGPLISQMDNPQSPYHVWGSFRRQGRQRTGLSQAVAPYITPGNNAPTLDEV<br>FRSILAGNPTDRATLDAALMQLLKACDGAGAIQQEGRSYWPKFCDPDSTANFAGDPAML<br>RREQHRLLLPQVLHDPAITHDSPALGSFDTYSIATPDTRTPQLTGPKARARLEQAITLWRV<br>RLPESAADFDRLASSLKKIPDDDSRLNLQGYVGSSAKGEVQARLFALLLFRHLERSSFTLG<br>LLRSATPPPKNAETPPPAGVPLPAASAADPVRIARGKRSFVFRAFTSLPCWHGGDNIHPTW<br>KSFDIAAFKYALTVINQIEEKTKERQKECAELETDFDYMHGRLAKIPVKYTTGEAEPPPIL<br>ANDLRIPLLRELLQNIKVDTALTDGEAVSYGLQRRTIRGFRELRRIWRGHAPAGTVFSSEL<br>KEKLAGELRQFQTDNSTTIGSVQLFNELIQNPKYWPIWQAPDVETARQWADAGFADDPL<br>AALVQEAELQEDIDALKAPVKLTPADPEYSRRQYDFNAVSKFGAGSRSANRHEPGQTER<br>GHNTFTTEIAARNAADGNRWRATHVRIHYSAPRLLRDGLRRPDTDGNEALEAVPWLQP<br>MMEALAPLPTLPQDLTGMPVFLMPDVTLSGERRILLNLPVTLEPAALVEQLGNAGRWQN<br>QFFGSREDPFALRWPADGAVKTAKGKTHIPWHQDRDHFTVLGVDLGTRDAGALALLNV<br>TAQKPAKPVHRIIGEADGRTWYASLADARMIRLPGEDARLFVRGKLVQEPYGERGRNAS<br>LLEWEDARNIILRLGQNPDELLGADPRRHSYPEINDKLLVALRRAQARLARLQNRSWRLR<br>DLAESDKALDEIHAERAGEKPSPLPPLARDDAIKSTDEALLSQRDIIRRSFVQIANLILPLRG<br>RRWEWRPHVEVPDCHILAQSDPGTDDTKRLVAGQRGISHERIEQIEELRRRCQSLNRALR<br>HKPGERPVLGRPAKGEEIADPCPALLEKINRLRDQRVDQTAHAILAAALGVRLRAPSKDR<br>AERRHRDIHGEYERFRAPADFVVIENLSRYLSSQDRARSENTRLMQWCHRQIVQKLRQL<br>CETYGIPVLAVPAAYSSRFSSRDGSAGFRAVHLTPDHRHRMPWSRILARLKAHEEDGKRL<br>EKTVLDEARAVRGLFDRLDRFNAGHVPGKPWRTLLAPLPGGPVFVPLGDATPMQADLN<br>AAINIALRGIAAPDRHDIHHRLRAENKKRILSLRLGTQREKARWPGGAPAVTLSTPNNGA<br>SPEDSDALPERVSNLFVDIAGVANFERVTIEGVSQKFATGRGLWASVKQRAWNRVARLN<br>ETVTDNNRNEEEDDIPM |

Amino Acid Sequence of Human Codon Optimized Cpf1 Orthologs

In certain of the following, Cpf1 amino acids are followed by nuclear localization signals (NLS) (italics), a glycine-serine (GS) linker, and 3× HA tag.

1- *Franscisella tularensis* subsp. *novicida* U112 (FnCpf1)

(SEQ ID NO: 27)

MSIYQEFVNKYSLSKTLRFELIPQGKTLENIKARGLILDDEKRAKDYKKAKQII

DKYHQFFIEEILSSVCISEDLLQNYSDVYFKLKKSDDDNLQKDFKSAKDTIKKQISEYIKD

SEKFKNLFNQNLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIKKD

LAEELTFDIDYKTSEVNQRVFSLDEVFEIANFNNYLNQSGITKFNTIIGGKFVNGENTKRK

GINEYINLYSQQINDKTLKKYKMSVLFKQILSDTESKSFVIDKLEDDSDVVTTMQSFYEQI

AAFKTVEEKSIKETLSLLFDDLKAQKLDLSKIYFKNDKSLTDLSQQVFDDYSVIGTAVLE

YITQQIAPKNLDNPSKKEQELIAKKTEKAKYLSLETIKLALEEFNKHRDIDKQCRFEEILA

NFAAIPMIFDEIAQNKDNLAQISIKYQNQGKKDLLQASAEDDVKAIKDLLDQTNNLLHK

```
LKIFHISQSEDKANILDKDEHFYLVFEECYFELANIVPLYNKIRNYITQKPYSDEKFKLNFE
NSTLANGWDKNKEPDNTAILFIKDDKYYLGVMNKKNNKIFDDKAIKENKGEGYKKIVY
KLLPGANKMLPKVFFSAKSIKFYNPSEDILRIRNHSTHTKNGSPQKGYEKFEFNIEDCRKF
IDFYKQSISKHPEWKDFGFRFSDTQRYNSIDEFYREVENQGYKLTFENISESYIDSVVNQG
KLYLFQIYNKDFSAYSKGRPNLHTLYWKALFDERNLQDVVYKLNGEAELFYRKQSIPK
KITHPAKEAIANKNKDNPKKESVFEYDLIKDKRFTEDKFFFHCPITINFKSSGANKFNDEI
NLLLKEKANDVHILSIDRGERHLAYYTLVDGKGNIIKQDTFNIIGNDRMKTNYHDKLAAI
EKDRDSARKDWKKINNIKEMKEGYLSQVVHEIAKLVIEYNAIVVFEDLNFGFKRGRFKV
EKQVYQKLEKMLIEKLNYLVFKDNEFDKTGGVLRAYQLTAPFETFKKMGKQTGIIYYV
PAGFTSKICPVTGFVNQLYPKYESVSKSQEFFSKFDKICYNLDKGYFEFSFDYKNFGDKA
AKGKWTIASFGSRLINFRNSDKNHNWDTREVYPTKELEKLLKDYSIEYGHGECIKAAIC
GESDKKFFAKLTSVLNTILQMRNSKTGTELDYLISPVADVNGNFFDSRQAPKNMPQDAD
ANGAYHIGLKGLMLLGRIKNNQEGKKLNLVIKNEEYFEFVQNRNN*KRPAATKKAGQAKK*
*KKGS*<ins>YPYDVPDYAYPYDVPDYAYPYDVPDYA</ins>

3- *Lachnospiraceae bacterium* MC2017 (Lb3Cpf1)
                                                      (SEQ ID NO: 28)
MDYGNGQFERRAPLTKTITLRLKPIGETRETIREQKLLEQDAAFRKLVETVTPI
VDDCIRKIADNALCHFGTEYDFSCLGNAISKNDSKAIKKETEKVEKLLAKVLTENLPDGL
RKVNDINSAAFIQDTLTSFVQDDADKRVLIQELKGKTVLMQRFLTTRITALTVWLPDRV
FENFNIFIENAEKMRILLDSPLNEKIMKFDPDAEQYASLEFYGQCLSQKDIDSYNLIISGIY
ADDEVKNPGINEIVKEYNQQIRGDKDESPLPKLKKLHKQILMPVEKAFFVRVLSNDSDA
RSILEKILKDTEMLPSKIIEAMKEADAGDIAVYGSRLHELSHVIYGDHGKLSQIIYDKESK
RISELMETLSPKERKESKKRLEGLEEHIRKSTYTFDELNRYAEKNVMAAYIAAVEESCAE
IMRKEKDLRTLLSKEDVKIRGNRHNTLIVKNYFNAWTVFRNLIRILRRKSEAEIDSDFYD
VLDDSVEVLSLTYKGENLCRSYITKKIGSDLKPEIATYGSALRPNSRWWSPGEKFNVKFH
TIVRRDGRLYYFILPKGAKPVELEDMDGDIECLQMRKIPNPTIFLPKLVFKDPEAFFRDNP
EADEFVFLSGMKAPVTITRETYEAYRYKLYTVGKLRDGEVSEEEYKRALLQVLTAYKEF
LENRMIYADLNFGFKDLEEYKDSSEFIKQVETHNTFMCWAKVSSSQLDDLVKSGNGLLF
EIWSERLESYYKYGNEKVLRGYEGVLLSILKDENLVSMRTLLNSRPMLVYRPKESSKPM
VVHRDGSRVVDRFDKDGKYIPPEVHDELYRFFNNLLIKEKLGEKARKILDNKKVKVKV
LESERVKWSKFYDEQFAVTFSVKKNADCLDTTKDLNAEVMEQYSESNRLILIRNTTDIL
YYLVLDKNGKVLKQRSLNIINDGARDVDWKERFRQVTKDRNEGYNEWDYSRTSNDLK
EVYLNYALKEIAEAVIEYNAILIIEKMSNAFKDKYSFLDDVTFKGFETKLLAKLSDLHFR
GIKDGEPCSFTNPLQLCQNDSNKILQDGVIFMVPNSMTRSLDPDTGFIFAINDHNIRTKKA
KLNFLSKFDQLKVSSEGCLIMKYSGDSLPTHNTDNRVWNCCCNHPITNYDRETKKVEFI
EEPVEELSRVLEENGIETDTELNKLNERENVPGKVVDAIYSLVLNYLRGTVSGVAGQRA
VYYSPVTGKKYDISFIQAMNLNRKCDYYRIGSKERGEWTDFVAQLIN*KRPAATKKAGQA*
*KKKKGS*<ins>YPYDVPDYAYPYDVPDYAYPYDVPDYA</ins>

4- *Butyrivibrio proteoclasticus* (BpCpf1)
                                                      (SEQ ID NO: 29)
MLLYENYTKRNQITKSLRLELRPQGKTLRNIKELNLLEQDKAIYALLERLKPV
IDEGIKDIARDTLKNCELSFEKLYEHFLSGDKKAYAKESERLKKEIVKTLIKNLPEGIGKIS
EINSAKYLNGVLYDFIDKTHKDSEEKQNILSDILETKGYLALFSKFLTSRITTLEQSMPKR
```

-continued

```
VIENFEIYAANIPKMQDALERGAVSFAIEYESICSVDYYNQILSQEDIDSYNRLISGIMDED
GAKEKGINQTISEKNIKIKSEHLEEKPFRILKQLHKQILEEREKAFTIDHIDSDEEVVQVTK
EAFEQTKEQWENIKKINGFYAKDPGDITLFIVVGPNQTHVLSQLIYGEHDRIRLLLEEYEK
NTLEVLPRRTKSEKARYDKFVNAVPKKVAKESHTFDGLQKMTGDDRLFILYRDELARN
YMRIKEAYGTFERDILKSRRGIKGNRDVQESLVSFYDELTKFRSALRIINSGNDEKADPIF
YNTFDGIFEKANRTYKAENLCRNYVTKSPADDARIMASCLGTPARLRTHWWNGEENFA
INDVAMIRRGDEYYYFVLTPDVKPVDLKTKDETDAQIFVQRKGAKSFLGLPKALFKCIL
EPYFESPEHKNDKNCVIEEYVSKPLTIDRRAYDIFKNGTFKKTNIGIDGLTEEKFKDDCRY
LIDVYKEFIAVYTRYSCFNMSGLKRADEYNDIGEFFSDVDTRLCTMEWIPVSFERINDMV
DKKEGLLFLVRSMFLYNRPRKPYERTFIQLFSDSNMEHTSMLLNSRAMIQYRAASLPRR
VTHKKGSILVALRDSNGEHIPMHIREAIYKMKNNFDISSEDFIMAKAYLAEHDVAIKKAN
EDIIRNRRYTEDKFFLSLSYTKNADISARTLDYINDKVEEDTQDSRMAVIVTRNLKDLTY
VAVVDEKNNVLEEKSLNEIDGVNYRELLKERTKIKYHDKTRLWQYDVSSKGLKEAYVE
LAVTQISKLATKYNAVVVVESMSSTFKDKFSFLDEQIFKAFEARLCARMSDLSFNTIKEG
EAGSISNPIQVSNNNGNSYQDGVIYFLNNAYTRTLCPDTGFVDVFDKTRLITMQSKRQFF
AKMKDIRIDDGEMLFTFNLEEYPTKRLLDRKEWTVKIAGDGSYFDKDKGEYVYVNDIV
REQIIPALLEDKAVFDGNMAEKFLDKTAISGKSVELIYKWFANALYGIITKKDGEKIYRSP
ITGTEIDVSKNTTYNFGKKFMFKQEYRGDGDFLDAFLNYMQAQDIAV*KRPAATKKAGQA*
*KKKKGS*YPYDVPDYAYPYDVPDYAYPYDVPDYA
```

5- *Peregrinibacteria bacterium* GW2011_GWA_33_10 (PeCpf1)

(SEQ ID NO: 30)

```
MSNFFKNFTNLYELSKTLRFELKPVGDTLTNMKDHLEYDEKLQTFLKDQNID
DAYQALKPQFDEIHEEFITDSLESKKAKEIDFSEYLDLFQEKKELNDSEKKLRNKIGETFN
KAGEKWKKEKYPQYEWKKGSKIANGADILSCQDMLQFIKYKNPEDEKIKNYIDDTLKG
FFTYFGGFNQNRANYYETKKEASTAVATRIVHENLPKFCDNVIQFKHIIKRKKDGTVEKT
ERKTEYLNAYQYLKNNNKITQIKDAETEKMIESTPIAEKIFDVYYFSSCLSQKQIEEYNRII
GHYNLLINLYNQAKRSEGKHLSANEKKYKDLPKFKTLYKQIGCGKKKDLFYTIKCDTEE
EANKSRNEGKESHSVEEIINKAQEAINKYFKSNNDCENINTVPDFINYILTKENYEGVYW
SKAAMNTISDKYFANYHDLQDRLKEAKVFQKADKKSEDDIKIPEAIELSGLFGVLDSLA
DWQTTLFKSSILSNEDKLKIITDSQTPSEALLKMIFNDIEKNMESFLKETNDIITLKKYKGN
KEGTEKIKQWFDYTLAINRMLKYFLVKENKIKGNSLDTNISEALKTLIYSDDAEWFKWY
DALRNYLTQKPQDEAKENKLKLNFDNPSLAGGWDVNKECSNFCVILKDKNEKKYLAIM
KKGENTLFQKEWTEGRGKNLTKKSNPLFEINNCEILSKMEYDFWADVSKMIPKCSTQLK
AVVNHFKQSDNEFIFPIGYKVTSGEKFREECKISKQDFELNNKVFNKNELSVTAMRYDLS
STQEKQYIKAFQKEYWELLFKQEKRDTKLTNNEIFNEWINFCNKKYSELLSWERKYKDA
LTNWINFCKYFLSKYPKTTLFNYSFKESENYNSLDEFYRDVDICSYKLNINTTINKSILDR
LVEEGKLYLFEIKNQDSNDGKSIGHKNNLHTIYWNAIFENFDNRPKLNGEAEIFYRKAIS
KDKLGIVKGKKTKNGTEIIKNYRFSKEKFILHVPITLNFCSNNEYVNDIVNTKFYNSNLH
FLGIDRGEKHLAYYSLVNKNGEIVDQGTLNLPFTDKDGNQRSIKKEKYFYNKQEDKWE
AKEVDCWNYNDLLDAMASNRDMARKNWQRIGTIKEAKNGYVSLVIRKIADLAVNNER
PAFIVLEDLNTGFKRSRQKIDKSVYQKFELALAKKLNFLVDKNAKRDEIGSPTKALQLTP
```

PVNNYGDIENKKQAGIMLYTRANYTSQTDPATGWRKTIYLKAGPEETTYKKDGKIKNK

SVKDQIIETFTDIGFDGKDYYFEYDKGEFVDEKTGEIKPKKWRLYSGENGKSLDRFRGER

EKDKYEWKIDKIDIVKILDDLFVNFDKNISLLKQLKEGVELTRNNEHGTGESLRFAINLIQ

QIRNTGNNERDNDFILSPVRDENGKHFDSREYWDKETKGEKISMPSSGDANGAFNIARK

GIIMNAHILANSDSKDLSLFVSDEEWDLHLNNKTEWKKQLNIFSSRKAMA*KRKKKRPAA*

*TKKAGQAKKKKGS*YPYDVPDYAYPYDVPDYAYPYDVPDYA

6- *Parcubacteria bacterium* GWC2011_GWC2_44_17 (PbCpf1)

(SEQ ID NO: 31)

MENIFDQFIGKYSLSKTLRFELKPVGKTEDFLKINKVFEKDQTIDDSYNQAKF

YFDSLHQKFIDAALASDKTSELSFQNFADVLEKQNKIILDKKREMGALRKRDKNAVGID

RLQKEINDAEDIIQKEKEKIYKDVRTLFDNEAESWKTYYQEREVDGKKITFSKADLKQK

GADFLTAAGILKVLKYEFPEEKEKEFQAKNQPSLFVEEKENPGQKRYIFDSFDKFAGYLT

KFQQTKKNLYAADGTSTAVATRIADNFIIFHQNTKVFRDKYKNNHTDLGFDEENIFEIER

YKNCLLQREIEHIKNENSYNKIIGRINKKIKEYRDQKAKDTKLTKSDFPFFKNLDKQILGE

VEKEKQLIEKTREKTEEDVLIERFKEFIENNEERFTAAKKLMNAFCNGEFESEYEGIYLKN

KAINTISRRWFVSDRDFELKLPQQKSKNKSEKNEPKVKKFISIAEIKNAVEELDGDIFKAV

FYDKKIIAQGGSKLEQFLVIWKYEFEYLFRDIERENGEKLLGYDSCLKIAKQLGIFPQEKE

AREKATAVIKNYADAGLGIFQMMKYFSLDDKDRKNTPGQLSTNFYAEYDGYYKDFEFI

KYYNEFRNFITKKPFDEDKIKLNFENGALLKGWDENKEYDFMGVILKKEGRLYLGIMH

KNHRKLFQSMGNAKGDNANRYQKMIYKQIADASKDVPRLLLTSKKAMEKFKPSQEILR

IKKEKTFKRESKNFSLRDLHALIEYYRNCIPQYSNWSFYDFQFQDTGKYQNIKEFTDDVQ

KYGYKISFRDIDDEYINQALNEGKMYLFEVVNKDIYNTKNGSKNLHTLYFEHILSAENL

NDPVFKLSGMAEIFQRQPSVNEREKITTQKNQCILDKGDRAYKYRRYTEKKIMFHMSLV

LNTGKGEIKQVQFNKIINQRISSSDNEMRVNVIGIDRGEKNLLYYSVVKQNGEIIEQASLN

EINGVNYRDKLIEREKERLKNRQSWKPVVKIKDLKKGYISHVIHKICQLIEKYSAIVVLED

LNMRFKQIRGGIERSVYQQFEKALIDKLGYLVFKDNRDLRAPGGVLNGYQLSAPFVSFE

KMRKQTGILFYTQAEYTSKTDPITGFRKNVYISNSASLDKIKEAVKKFDAIGWDGKEQS

YFFKYNPYNLADEKYKNSTVSKEWAIFASAPRIRRQKGEDGYWKYDRVKVNEEFEKLL

KVWNFVNPKATDIKQEIIKKEKAGDLQGEKELDGRLRNFWHSFIYLFNLVLELRNSFSLQ

IKIKAGEVIAVDEGVDFIASPVKPFFTTPNPYIPSNLCWLAVENADANGAYNIARKGVMI

LKKIREHAKKDPEFKKLPNLFISNAEWDEAARDWGKYAGTTALNLDH*KRPAATKKAGQ*

*AKKKKGS*YPYDVPDYAYPYDVPDYAYPYDVPDYA

7- *Smithella sp.* SC_K08D17 (SsCpf1)

(SEQ ID NO: 32)

MQTLFENFTNQYPVSKTLRFELIPQGKTKDFIEQKGLLKKDEDRAEKYKKVK

NIIDEYHKDFIEKSLNGLKLDGLEKYKTLYLKQEKDDKDKKAFDKEKENLRKQIANAFR

NNEKFKTLFAKELIKNDLMSFACEEDKKNVKEFEAFTTYFTGFHQNRANMYVADEKRT

AIASRLIHENLPKFIDNIKIFEKMKKEAPELLSPFNQTLKDMKDVIKGTTLEEIFSLDYFNK

TLTQSGIDIYNSVIGGRTPEEGKTKIKGLNEYINTDFNQKQTDKKKRQPKFKQLYKQILSD

RQSLSFIAEAFKNDTEILEAIEKFYVNELLHFSNEGKSTNVLDAIKNAVSNLESFNLTKMY

FRSGASLTDVSRKVFGEWSIINRALDNYYATTYPIKPREKSEKYEERKEKWLKQDFNVS

LIQTAIDEYDNETVKGKNSGKVIADYFAKFCDDKETDLIQKVNEGYIAVKDLLNTPCPEN

-continued

EKLGSNKDQVKQIKAFMDSIMDIMHFVRPLSLKDTDKEKDETFYSLFTPLYDHLTQTIAL

YNKVRNYLTQKPYSTEKIKLNFENSTLLGGWDLNKETDNTAIILRKDNLYYLGIMDKRH

NRIFRNVPKADKKDFCYEKMVYKLLPGANKMLPKVFFSQSRIQEFTPSAKLLENYANET

HKKGDNFNLNHCHKLIDFFKDSINKHEDWKNFDFRFSATSTYADLSGFYHEVEHQGYKI

SFQSVADSFIDDLVNEGKLYLFQIYNKDFSPFSKGKPNLHTLYWKMLFDENNLKDVVYK

LNGEAEVFYRKKSIAEKNTTIHKANESIINKNPDNPKATSTFNYDIVKDKRYTIDKFQFHI

PITMNFKAEGIFNMNQRVNQFLKANPDINIIGIDRGERHLLYYALINQKGKILKQDTLNVI

ANEKQKVDYHNLLDKKEGDRATARQEWGVIETIKELKEGYLSQVIHKLTDLMIENNAII

VMEDLNFGFKRGRQKVEKQVYQKFEKMLIDKLNYLVDKNKKANELGGLLNAFQLANK

FESFQKMGKQNGFIFYVPAWNTSKTDPATGFIDFLKPRYENLNQAKDFFEKFDSIRLNSK

ADYFEFAFDFKNFTEKADGGRTKWTVCTTNEDRYAWNRALNNNRGSQEKYDITAELK

SLFDGKVDYKSGKDLKQQIASQESADFFKALMKNLSITLSLRHNNGEKGDNEQDYILSP

VADSKGRFFDSRKADDDMPKNADANGAYHIALKGLWCLEQISKTDDLKKVKLAISNKE

WLEFVQTLKG*KRPAATKKAGQAKKKKGS*YPYDVPDYAYPYDVPDYAYPYDVPDYA*

8- *Acidaminococcus* sp. BV3L6 (AsCpf1)
(SEQ ID NO: 33)
MTQFEGFTNLYQVSKTLRFELIPQGKTLKHIQEQGFIEEDKARNDHYKELKPII

DRIYKTYADQCLQLVQLDWENLSAAIDSYRKEKTEETRNALIEEQATYRNAIHDYFIGRT

DNLTDAINKRHAEIYKGLFKAELFNGKVLKQLGTVTTTEHENALLRSFDKFTTYFSGFYE

NRKNVFSAEDISTAIPHRIVQDNFPKFKENCHIFTRLITAVPSLREHFENVKKAIGIFVSTSI

EEVFSFPFYNQLLTQTQIDLYNQLLGGISREAGTEKIKGLNEVLNLAIQKNDETAHIIASLP

HRFIPLFKQILSDRNTLSFILEEFKSDEEVIQSFCKYKTLLRNENVLETAEALFNELNSIDLT

HIFISHKKLETISSALCDHWDTLRNALYERRISELTGKITKSAKEKVQRSLKHEDINLQEII

SAAGKELSEAFKQKTSEILSHAHAALDQPLPTTLKKQEEKEILKSQLDSLLGLYHLLDWF

AVDESNEVDPEFSARLTGIKLEMEPSLSFYNKARNYATKKPYSVEKFKLNFQMPTLASG

WDVNKEKNNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEKEPKKFQTAYAK

KTGDQKGYREALCKWIDFTRDFLSKYTKTTSIDLSSLRPSSQYKDLGEYYAELNPLLYHI

SFQRIAEKEIMDAVETGKLYLFQIYNKDFAKGHHGKPNLHTLYWTGLFSPENLAKTSIKL

NGQAELFYRPKSRMKRMAHRLGEKMLNKKLKDQKTPIPDTLYQELYDYVNHRLSHDL

SDEARALLPNVITKEVSHEIIKDRRFTSDKFFFHVPITLNYQAANSPSKFNQRVNAYLKEH

PETPIIGIDRGERNLIYITVIDSTGKILEQRSLNTIQQFDYQKKLDNREKERVAARQAWSV

VGTIKDLKQGYLSQVIHEIVDLMIHYQAVVVLENLNFGFKSKRTGIAEKAVYQQFEKML

IDKLNCLVLKDYPAEKVGGVLNPYQLTDQFTSFAKMGTQSGFLFYVPAPYTSKIDPLTG

FVDPFVWKTIKNHESRKHFLEGFDFLHYDVKTGDFILHFKMNRNLSFQRGLPGFMPAW

DIVFEKNETQFDAKGTPFIAGKRIVPVIENHRFTGRYRDLYPANELIALLEEKGIVFRDGS

NILPKLLENDDSHAIDTMVALIRSVLQMRNSNAATGEDYINSPVRDLNGVCFDSRFQNPE

WPMDADANGAYHIALKGQLLLNHLKESKDLKLQNGISNQDWLAYIQELRN*KRPAATKK*

*AGQAKKKKGS*YPYDVPDYAYPYDVPDYAYPYDVPDYA*

9- *Lachnospiraceae bacterium* MA2020 (Lb2Cpf1)
(SEQ ID NO: 34)
MYYESLTKQYPVSKTIRNELIPIGKTLDNIRQNNILESDVKRKQNYEHVKGILD

EYHKQLINEALDNCTLPSLKIAAEIYLKNQKEVSDREDFNKTQDLLRKEVVEKLKAHEN

-continued

FTKIGKKDILDLLEKLPSISEDDYNALESFRNFYTYFTSYNKVRENLYSDKEKSSTVAYRL

INENFPKFLDNVKSYRFVKTAGILADGLGEEEQDSLFIVETFNKTLTQDGIDTYNSQVGKI

NSSINLYNQKNQKANGFRKIPKMKMLYKQILSDREESFIDEFQSDEVLIDNVESYGSVLIE

SLKSSKVSAFFDALRESKGKNVYVKNDLAKTAMSNIVFENWRTFDDLLNQEYDLANEN

KKKDDKYFEKRQKELKKNKSYSLEHLCNLSEDSCNLIENYIHQISDDIENIIINNETFLRIV

INEHDRSRKLAKNRKAVKAIKDFLDSIKVLERELKLINSSGQELEKDLIVYSAHEELLVEL

KQVDSLYNMTRNYLTKKPFSTEKVKLNFNRSTLLNGWDRNKETDNLGVLLLKDGKYY

LGIMNTSANKAFVNPPVAKTEKVFKKVDYKLLPVPNQMLPKVFFAKSNIDFYNPSSEIYS

NYKKGTHKKGNMFSLEDCHNLIDFFKESISKHEDWSKFGFKFSDTASYNDISEFYREVE

KQGYKLTYTDIDETYINDLIERNELYLFQIYNKDFSMYSKGKLNLHTLYFMMLFDQRNI

DDVVYKLNGEAEVFYRPASISEDELIIHKAGEEIKNKNPNRARTKETSTFSYDIVKDKRY

SKDKFTLHIPITMNFGVDEVKRFNDAVNSAIRIDENVNVIGIDRGERNLLYVVVIDSKGNI

LEQISLNSIINKEYDIETDYHALLDEREGGRDKARKDWNTVENIRDLKAGYLSQVVNVV

AKLVLKYNAIICLEDLNFGFKRGRQKVEKQVYQKFEKMLIDKLNYLVIDKSREQTSPKE

LGGALNALQLTSKFKSFKELGKQSGVIYYVPAYLTSKIDPTTGFANLFYMKCENVEKSK

RFFDGFDFIRFNALENVFEFGFDYRSFTQRACGINSKWTVCTNGERIIKYRNPDKNNMFD

EKVVVVTDEMKNLFEQYKIPYEDGRNVKDMIISNEEAEFYRRLYRLLQQTLQMRNSTSD

GTRDYIISPVKNKREAYFNSELSDGSVPKADANGAYNIARKGLWVLEQIRQKSEGEKI

NLAMTNAEWLEYAQTHLL*KRPAATKKAGQAKKKK*GSYPYDVPDYAYPYDVPDYAYPY

DVPDYA

10- *Candidatus Methanoplasma termitum* (CMtCpf1)
(SEQ ID NO: 35)
MNNYDEFTKLYPIQKTIRFELKPQGRTMEHLETFNFFEEDRDRAEKYKILKEA

IDEYHKKFIDEHLTNMSLDWNSLKQISEKYYKSREEKDKKVFLSEQKRMRQEIVSEFKK

DDRFKDLFSKKLFSELLKEEIYKKGNHQEIDALKSFDKFSGYFIGLHENRKNMYSDGDEI

TAISNRIVNENFPKFLDNLQKYQEARKKYPEWIIKAESALVAHNIKMDEVFSLEYFNKVL

NQEGIQRYNLALGGYVTKSGEKMMGLNDALNLAHQSEKSSKGRIHMTPLFKQILSEKES

FSYIPDVFTEDSQLLPSIGGFFAQIENDKDGNIFDRALELISSYAEYDTERIYIRQADINRVS

NVIFGEWGTLGGLMREYKADSINDINLERTCKKVDKWLDSKEFALSDVLEAIKRTGNN

DAFNEYISKMRTAREKIDAARKEMKFISEKISGDEESIHIIKTLLDSVQQFLHFFNLFKAR

QDIPLDGAFYAEFDEVHSKLFAIVPLYNKVRNYLTKNNLNTKKIKLNFKNPTLANGWDQ

NKVYDYASLIFLRDGNYYLGIINPKRKKNIKFEQGSGNGPFYRKMVYKQIPGPNKNLPR

VFLTSTKGKKEYKPSKEIIEGYEADKHIRGDKFDLDFCHKLIDFFKESIEKHKDWSKFNF

YFSPTESYGDISEFYLDVEKQGYRMHFENISAETIDEYVEKGDLFLFQIYNKDFVKAATG

KKDMHTIYWNAAFSPENLQDVVVKLNGEAELFYRDKSDIKEIVHREGEILVNRTYNGRT

PVPDKIHKKLTDYHNGRTKDLGEAKEYLDKVRYFKAHYDITKDRRYLNDKIYFHVPLT

LNFKANGKKNLNKMVIEKFLSDEKAHIIGIDRGERNLLYYSIIDRSGKIIDQQSLNVIDGF

DYREKLNQREIEMKDARQSWNAIGKIKDLKEGYLSKAVHEITKMAIQYNAIVVMEELN

YGFKRGRFKVEKQIYQKFENMLIDKMNYLVFKDAPDESPGGVLNAYQLTNPLESFAKL

GKQTGILFYVPAAYTSKIDPTTGFVNLFNTSSKTNAQERKEFLQKFESISYSAKDGGIFAF

AFDYRKFGTSKTDHKNVWTAYTNGERMRYIKEKKRNELFDPSKEIKEALTSSGIKYDGG

-continued

QNILPDILRSNNNGLIYTMYSSFIAAIQMRVYDGKEDYIISPIKNSKGEFFRTDPKRRELPI

DADANGAYNIALRGELTMRAIAEKFDPDSEKMAKLELKHKDWFEFMQTRGD*KRPAATK*

*KAGQAKKKK*GSYPYDVPDYAYPYDVPDYAYPYDVPDYA

11- *Eubacterium eligens* (EeCpf1)

(SEQ ID NO: 36)
MNGNRSIVYREFVGVIPVAKTLRNELRPVGHTQEHIIQNGLIQEDELRQEKST

ELKNIMDDYYREYIDKSLSGVTDLDFTLLFELMNLVQSSPSKDNKKALEKEQSKMREQI

CTHLQSDSNYKNIFNAKLLKEILPDFIKNYNQYDVKDKAGKLETLALFNGFSTYFTDFFE

KRKNVFTKEAVSTSIAYRIVHENSLIFLANMTSYKKISEKALDEIEVIEKNNQDKMGDWE

LNQIFNPDFYNMVLIQSGIDFYNEICGVVNAHMNLYCQQTKNNYNLFKMRKLHKQILA

YTSTSFEVPKMFEDDMSVYNAVNAFIDETEKGNIIGKLKDIVNKYDELDEKRIYISKDFY

ETLSCFMSGNWNLITGCVENFYDENIHAKGKSKEEKVKKAVKEDKYKSINDVNDLVEK

YIDEKERNEFKNSNAKQYIREISNIITDTETAHLEYDDHISLIESEEKADEMKKRLDMYM

NMYHWAKAFIVDEVLDRDEMFYSDIDDIYNILENIVPLYNRVRNYVTQKPYNSKKIKLN

FQSPTLANGWSQSKEFDNNAIILIRDNKYYLAIFNAKNKPDKKIIQGNSDKKNDNDYKK

MVYNLLPGANKMLPKVFLSKKGIETFKPSDYIISGYNAHKHIKTSENFDISFCRDLIDYFK

NSIEKHAEWRKYEFKFSATDSYSDISEFYREVEMQGYRIDWTYISEADINKLDEEGKIYL

FQIYNKDFAENSTGKENLHTMYFKNIFSEENLKDIIIKLNGQAELFYRRASVKNPVKHKK

DSVLVNKTYKNQLDNGDVVRIPIPDDIYNEIYKMYNGYIKESDLSEAAKEYLDKVEVRT

AQKDIVKDYRYTVDKYFIHTPITINYKVTARNNVNDMVVKYIAQNDDIHVIGIDRGERN

LIYISVIDSHGNIVKQKSYNILNNYDYKKKLVEKEKTREYARKNWKSIGNIKELKEGYIS

GVVHEIAMLIVEYNAIIAMEDLNYGFKRGRFKVERQVYQKFESMLINKLNYFASKEKSV

DEPGGLLKGYQLTYVPDNIKNLGKQCGVIFYVPAAFTSKIDPSTGFISAFNFKSISTNASR

KQFFMQFDEIRYCAEKDMFSFGFDYNNFDTYNITMGKTQWTVYTNGERLQSEFNNARR

TGKTKSINLTETIKLLLEDNEINYADGHDIRIDMEKMDEDKKSEFFAQLLSLYKLTVQMR

NSYTEAEEQENGISYDKIISPVINDEGEFFDSDNYKESDDKECKMPKDADANGAYCIALK

GLYEVLKIKSEWTEDGFDRNCLKLPHAEWLDFIQNKRYE*KRPAATKKAGQAKKKK*GSYP

YDVPDYAYPYDVPDYAYPYDVPDYA

12- *Moraxella bovoculi* 237 (MbCpf1)

(SEQ ID NO: 37)
MLFQDFTHLYPLSKTVRFELKPIDRTLEHIHAKNFLSQDETMADMHQKVKVI

LDDYHRDFIADMMGEVKLTKLAEFYDVYLKFRKNPKDDELQKQLKDLQAVLRKEIVKP

IGNGGKYKAGYDRLFGAKLFKDGKELGDLAKFVIAQEGESSPKLAHLAHFEKFSTYFTG

FHDNRKNMYSDEDKHTAIAYRLIHENLPRFIDNLQILTTIKQKHSALYDQIINELTASGLD

VSLASHLDGYHKLLTQEGITAYNTLLGGISGEAGSPKIQGINELINSHHNQHCHKSERIAK

LRPLHKQILSDGMSVSFLPSKFADDSEMCQAVNEFYRHYADVFAKVQSLFDGFDDHQK

DGIYVEHKNLNELSKQAFGDFALLGRVLDGYYVDVVNPEFNERFAKAKTDNAKAKLT

KEKDKFIKGVHSLASLEQAIEHYTARHDDESVQAGKLGQYFKHGLAGVDNPIQKIHNNH

STIKGFLERERPAGERALPKIKSGKNPEMTQLRQLKELLDNALNVAHFAKLLTTKTTLDN

QDGNFYGEFGVLYDELAKIPTLYNKVRDYLSQKPFSTEKYKLNFGNPTLLNGWDLNKE

KDNFGVILQKDGCYYLALLDKAHKKVFDNAPNTGKSIYQKMIYKYLEVRKQFPKVFFS

KEAIAINYHPSKELVEIKDKGRQRSDDERLKLYRFILECLKIHPKYDKKFEGAIGDIQLFK

KDKKGREVPISEKDLFDKINGIFSSKPKLEMEDFFIGEFKRYNPSQDLVDQYNIYKKIDSN

-continued

DNRKKENFYNNHPKFKKDLVRYYYESMCKHEEWEESFEFSKKLQDIGCYVDVNELFTE

IETRRLNYKISFCNINADYIDELVEQGQLYLFQIYNKDFSPKAHGKPNLHTLYFKALFSED

NLADPIYKLNGEAQIFYRKASLDMNETTIHRAGEVLENKNPDNKKRQFVYDIIKDKRY

TQDKFMLHVPITMNFGVQGMTIKEFNKKVNQSIQQYDEVNVIGIDRGERHLLYLTVINS

KGEILEQCSLNDITTASANGTQMTTPYHKILDKREIERLNARVGWGEIETIKELKSGYLSH

VVHQISQLMLKYNAIVVLEDLNFGFKRGRFKVEKQIYQNFENALIKKLNHLVLKDKAD

DEIGSYKNALQLTNNFTDLKSIGKQTGFLFYVPAWNTSKIDPETGFVDLLKPRYENIAQS

QAFFGKFDKICYNADKDYFEFHIDYAKFTDKAKNSRQIWTICSHGDKRYVYDKTANQN

KGAAKGINVNDELKSLFARHHINEKQPNLVMDICQNNDKEFHKSLMYLLKTLLALRYS

NASSDEDFILSPVANDEGVFFNSALADDTQPQNADANGAYHIALKGLWLLNELKNSDD

LNKVKLAIDNQTWLNFAQNR*KRPAATKKAGQAKKKK*GSYPYDVPDYAYPYDVPDYAY

PYDVPDYA

13- *Leptospira inadai* (LiCpf1)
(SEQ ID NO: 38)

MEDYSGFVNIYSIQKTLRFELKPVGKTLEHIEKKGFLKKDKIRAEDYKAVKKII

DKYHRAYIEEVFDSVLHQKKKKDKTRFSTQFIKEIKEFSELYYKTEKNIPDKERLEALSE

KLRKMLVGAFKGEFSEEVAEKYKNLFSKELIRNEIEKFCETDEERKQVSNFKSFTTYFTG

FHSNRQNIYSDEKKSTAIGYRIIHQNLPKFLDNLKIIESIQRRFKDFPWSDLKKNLKKIDKN

IKLTEYFSIDGFVNVLNQKGIDAYNTILGGKSEESGEKIQGLNEYINLYRQKNNIDRKNLP

NVKILFKQILGDRETKSFIPEAFPDDQSVLNSITEFAKYLKLDKKKKSIIAELKKFLSSFNR

YELDGIYLANDNSLASISTFLFDDWSFIKKSVSFKYDESVGDPKKKIKSPLKYEKEKEKW

LKQKYYTISFLNDAIESYSKSQDEKRVKIRLEAYFAEFKSKDDAKKQFDLLERIEEAYAIV

EPLLGAEYPRDRNLKADKKEVGKIKDFLDSIKSLQFFLKPLLSAEIFDEKDLGFYNQLEG

YYEEIDSIGHLYNKVRNYLTGKIYSKEKFKLNFENSTLLKGWDENREVANLCVIFREDQ

KYYLGVMDKENNTILSDIPKVKPNELFYEKMVYKLIPTPHMQLPRIIFSSDNLSIYNPSKSI

LKIREAKSFKEGKNFKLKDCHKFIDFYKESISKNEDWSRFDFKFSKTSSYENISEFYREVE

RQGYNLDFKKVSKFYIDSLVEDGKLYLFQIYNKDFSIFSKGKPNLHTIYFRSLFSKENLKD

VCLKLNGEAEMFFRKKSINYDEKKKREGHHPELFEKLKYPILKDKRYSEDKFQFHLPISL

NFKSKERLNFNLKVNEFLKRNKDINIIGIDRGERNLLYLVMINQKGEILKQTLLDSMQSG

KGRPEINYKEKLQEKEIERDKARKSWGTVENIKELKEGYLSIVIHQISKLMVENNAIVVL

EDLNIGFKRGRQKVERQVYQKFEKMLIDKLNFLVFKENKPTEPGGVLKAYQLTDEFQSF

EKLSKQTGFLFYVPSWNTSKIDPRTGFIDFLHPAYENIEKAKQWINKFDSIRFNSKMDWF

EFTADTRKFSENLMLGKNRVWVICTTNVERYFTSKTANSSIQYNSIQITEKLKELFVDIPF

SNGQDLKPEILRKNDAVFFKSLLFYIKTTLSLRQNNGKKGEEEKDFILSPVVDSKGRFFNS

LEASDDEPKDADANGAYHIALKGLMNLLVLNETKEENLSRPKWKIKNKDWLEFVWER

NR*KRPAATKKAGQAKKKK*GSYPYDVPDYAYPYDVPDYAYPYDVPDYA

14- *Lachnospiraceae bacterium* ND2006 (LbCpf1)
(SEQ ID NO: 39)

MSKLEKFTNCYSLSKTLRFKAIPVGKTQENIDNKRLLVEDEKRAEDYKGVKK

LLDRYYLSFINDVLHSIKLKNLNNYISLFRKKTRTEKENKELENLEINLRKEIAKAFKGNE

GYKSLFKKDIIETILPEFLDDKDEIALVNSFNGFTTAFTGFFDNRENMFSEEAKSTSIAFRC

INENLTRYISNMDIFEKVDAIFDKHEVQEIKEKILNSDYDVEDFFEGEFFNFVLTQEGIDV

-continued

YNAIIGGFVTESGEKIKGLNEYINLYNQKTKQKLPKFKPLYKQVLSDRESLSFYGEGYTS

DEEVLEVFRNTLNKNSEIFSSIKKLEKLFKNFDEYSSAGIFVKNGPAISTISKDIFGEWNVI

RDKWNAEYDDIHLKKKAVVTEKYEDDRRKSFKKIGSFSLEQLQEYADADLSVVEKLKE

IIIQKVDEIYKVYGSSEKLFDADFVLEKSLKKNDAVVAIMKDLLDSVKSFENYIKAFFGE

GKETNRDESFYGDFVLAYDILLKVDHIYDAIRNYVTQKPYSKDKFKLYFQNPQFMGGW

DKDKETDYRATILRYGSKYYLAIMDKKYAKCLQKIDKDDVNGNYEKINYKLLPGPNKM

LPKVFFSKKWMAYYNPSEDIQKIYKNGTFKKGDMFNLNDCHKLIDFFKDSISRYPKWSN

AYDFNFSETEKYKDIAGFYREVEEQGYKVSFESASKKEVDKLVEEGKLYMFQIYNKDFS

DKSHGTPNLHTMYFKLLFDENNHGQIRLSGGAELFMRRASLKKEELVVHPANSPIANKN

PDNPKKTTTLSYDVYKDKRFSEDQYELHIPIAINKCPKNIFKINTEVRVLLKHDDNPYVIG

IDRGERNLLYIVVVDGKGNIVEQYSLNEIINNFNGIRIKTDYHSLLDKKEKERFEARQNW

TSIENIKELKAGYISQVVHKICELVEKYDAVIALEDLNSGFKNSRVKVEKQVYQKFEKML

IDKLNYMVDKKSNPCATGGALKGYQITNKFESFKSMSTQNGFIFYIPAWLTSKIDPSTGF

VNLLKTKYTSIADSKKFISSFDRIMYVPEEDLFEFALDYKNFSRTDADYIKKWKLYSYGN

RIRIFRNPKKNNVFDWEEVCLTSAYKELFNKYGINYQQGDIRALLCEQSDKAFYSSFMA

LMSLMLQMRNSITGRTDVDFLISPVKNSDGIFYDSRNYEAQENAILPKNADANGAYNIA

RKVLWAIGQFKKAEDEKLDKVKIAISNKEWLEYAQTSVKH*KRPAATKKAGQAKKKK*GS

YPYDVPDYAYPYDVPDYAYPYDVPDYA

15- *Porphyromonas crevioricanis* (PcCpf1)
(SEQ ID NO: 40)

MDSLKDFTNLYPVSKTLRFELKPVGKTLENIEKAGILKEDEHRAESYRRVKKI

IDTYHKVFIDSSLENMAKMGIENEIKAMLQSFCELYKKDHRTEGEDKALDKIRAVLRGLI

VGAFTGVCGRRENTVQNEKYESLFKEKLIKEILPDFVLSTEAESLPFSVEEATRSLKEFDS

FTSYFAGFYENRKNIYSTKPQSTAIAYRLIHENLPKFIDNILVFQKIKEPIAKELEHIRADFS

AGGYIKKDERLEDIFSLNYYIHVLSQAGIEKYNALIGKIVTEGDGEMKGLNEHINLYNQQ

RGREDRLPLFRPLYKQILSDREQLSYLPESFEKDEELLRALKEFYDHIAEDILGRTQQLMT

SISEYDLSRIYVRNDSQLTDISKKMLGDWNAIYMARERAYDHEQAPKRITAKYERDRIK

ALKGEESISLANLNSCIAFLDNVRDCRVDTYLSTLGQKEGPHGLSNLVENVFASYHEAE

QLLSFPYPEENNLIQDKDNVVLIKNLLDNISDLQRFLKPLWGMGDEPDKDERFYGEYNYI

RGALDQVIPLYNKVRNYLTRKPYSTRKVKLNFGNSQLLSGWDRNKEKDNSCVILRKGQ

NFYLAIMNNRHKRSFENKMLPEYKEGEPYFEKMDYKFLPDPNKMLPKVFLSKKGIEIYK

PSPKLLEQYGHGTHKKGDTFSMDDLHELIDFFKHSIEAHEDWKQFGFKFSDTATYENVS

SFYREVEDQGYKLSFRKVSESYVYSLIDQGKLYLFQIYNKDFSPCSKGTPNLHTLYWRM

LFDERNLADVIYKLDGKAEIFFREKSLKNDHPTHPAGKPIKKKSRQKKGEESLFEYDLVK

DRRYTMDKFQFHVPITMNFKCSAGSKVNDMVNAHIREAKDMHVIGIDRGERNLLYICVI

DSRGTILDQISLNTINDIDYHDLLESRDKDRQQEHRNWQTIEGIKELKQGYLSQAVHRIA

ELMVAYKAVVALEDLNMGFKRGRQKVESSVYQQFEKQLIDKLNYLVDKKKRPEDIGG

LLRAYQFTAPFKSFKEMGKQNGFLFYIPAWNTSNIDPTTGFVNLFHVQYENVDKAKSFF

QKFDSISYNPKKDWFEFAFDYKNFTKKAEGSRSMWILCTHGSRIKNFRNSQKNGQWDS

EEFALTEAFKSLFVRYEIDYTADLKTAIVDEKQKDFFVDLLKLFKLTVQMRNSWKEKDL

-continued

DYLISPVAGADGRFFDTREGNKSLPKDADANGAYNIALKGLWALRQIRQTSEGGKLKL

AISNKEWLQFVQERSYEKD*KRPAATKKAGQA*KKKKGSYPYDVPDYAYPYDVPDYAYPY

DVPDYA

16- *Prevotella disiens* (PdCpf1)

(SEQ ID NO: 41)

MENYQEFTNLFQLNKTLRFELKPIGKTCELLEEGKIFASGSFLEKDKVRADNV

SYVKKEIDKKHKIFIEETLSSFSISNDLLKQYFDCYNELKAFKKDCKSDEEEVKKTALRN

KCTSIQRAMREAISQAFLKSPQKKLLAIKNLIENVFKADENVQHFSEFTSYFSGFETNREN

FYSDEEKSTSIAYRLVHDNLPIFIKNIYIFEKLKEQFDAKTLSEIFENYKLYVAGSSLDEVF

SLEYFNNTLTQKGIDNYNAVIGKIVKEDKQEIQGLNEHINLYNQKHKDRRLPFFISLKKQI

LSDREALSWLPDMFKNDSEVIKALKGFYIEDGFENNVLTPLATLLSSLDKYNLNGIFIRN

NEALSSLSQNVYRNFSIDEAIDANAELQTFNNYELIANALRAKIKKETKQGRKSFEKYEE

YIDKKVKAIDSLSIQEINELVENYVSEFNSNSGNMPRKVEDYFSLMRKGDFGSNDLIENI

KTKLSAAEKLLGTKYQETAKDIFKKDENSKLIKELLDATKQFQHFIKPLLGTGEEADRDL

VFYGDFLPLYEKFEELTLLYNKVRNRLTQKPYSKDKIRLCFNKPKLMTGWVDSKTEKSD

NGTQYGGYLFRKKNEIGEYDYFLGISSKAQLFRKNEAVIGDYERLDYYQPKANTIYGSA

YEGENSYKEDKKRLNKVIIAYIEQIKQTNIKKSIIESISKYPNISDDDKVTPSSLLEKIKKVSI

DSYNGILSFKSFQSVNKEVIDNLLKTISPLKNKAEFLDLINKDYQIFTEVQAVIDEICKQKT

FIYFPISNVELEKEMGDKDKPLCLFQISNKDLSFAKTFSANLRKKRGAENLHTMLFKALM

EGNQDNLDLGSGAIFYRAKSLDGNKPTHPANEAIKCRNVANKDKVSLFTYDIYKNRRY

MENKFLFHLSIVQNYKAANDSAQLNSSATEYIRKADDLHIIGIDRGERNLLYYSVIDMKG

NIVEQDSLNIIRNNDLETDYHDLLDKREKERKANRQNWEAVEGIKDLKKGYLSQAVHQI

AQLMLKYNAIIALEDLGQMFVTRGQKIEKAVYQQFEKSLVDKLSYLVDKKRPYNELGGI

LKAYQLASSITKNNSDKQNGFLFYVPAWNTSKIDPVTGFTDLLRPKAMTIKEAQDFFGA

FDNISYNDKGYFEFETNYDKFKIRMKSAQTRWTICTFGNRIKRKKDKNYWNYEEVELTE

EFKKLFKDSNIDYENCNLKEEIQNKDNRKFFDDLIKLLQLTLQMRNSDDKGNDYIISPVA

NAEGQFFDSRNGDKKLPLDADANGAYNIARKGLWNIRQIKQTKNDKKLNLSISSTEWL

DFVREKPYLKKRPAATK*KAGQA*KKKKGSYPYDVPDYAYPYDVPDYAYPYDVPDYA

17- *Porphyromonas macacae* (PmCpf1)

(SEQ ID NO: 42)

MKTQHFFEDFTSLYSLSKTIRFELKPIGKTLENIKKNGLIRRDEQRLDDYEKLK

KVIDEYHEDFIANILSSFSFSEEILQSYIQNLSESEARAKIEKTMRDTLAKAFSEDERYKSIF

KKELVKKDIPVWCPAYKSLCKKFDNFTTSLVPFHENRKNLYTSNEITASIPYRIVHVNLP

KFIQNIEALCELQKKMGADLYLEMMENLRNVWPSFVKTPDDLCNLKTYNHLMVQSSIS

EYNRFVGGYSTEDGTKHQGINEWINIYRQRNKEMRLPGLVFLHKQILAKVDSSSFISDTL

ENDDQVFCVLRQFRKLFWNTVSSKEDDAASLKDLFCGLSGYDPEAIYVSDAHLATISKN

IFDRWNYISDAIRRKTEVLMPRKKESVERYAEKISKQIKKRQSYSLAELDDLLAHYSEES

LPAGFSLLSYFTSLGGQKYLVSDGEVILYEEGSNIWDEVLIAFRDLQVILDKDFTEKKLG

KDEEAVSVIKKALDSALRLRKFFDLLSGTGAEIRRDSSFYALYTDRMDKLKGLLKMYD

KVRNYLTKKPYSIEKFKLHFDNPSLLSGWDKNKELNNLSVIFRQNGYYYLGIMTPKGKN

LFKTLPKLGAEEMFYEKMEYKQIAEPMLMLPKVFFPKKTKPAFAPDQSVVDIYNKKTFK

TGQKGFNKKDLYRLIDFYKEALTVHEWKLFNFSFSPTEQYRNIGEFFDEVREQAYKVSM

VNVPASYIDEAVENGKLYLFQIYNKDFSPYSKGIPNLHTLYWKALFSEQNQSRVYKLCG

-continued

GGELFYRKASLHMQDTTVHPKGISIHKKNLNKKGETSLFNYDLVKDKRFTEDKFFFHVP

ISINYKNKKITNVNQMVRDYIAQNDDLQIIGIDRGERNLLYISRIDTRGNLLEQFSLNVIES

DKGDLRTDYQKILGDREQERLRRRQEWKSIESIKDLKDGYMSQVVHKICNMVVEHKAI

VVLENLNLSFMKGRKKVEKSVYEKFERMLVDKLNYLVVDKKNLSNEPGGLYAAYQLT

NPLFSFEELHRYPQSGILFFVDPWNTSLTDPSTGFVNLLGRINYTNVGDARKFFDRFNAIR

YDGKGNILFDLDLSRFDVRVETQRKLWTLTTFGSRIAKSKKSGKWMVERIENLSLCFLE

LFEQFNIGYRVEKDLKKAILSQDRKEFYVRLIYLFNLMMQIRNSDGEEDYILSPALNEKN

LQFDSRLIEAKDLPVDADANGAYNVARKGLMVVQRIKRGDHESIHRIGRAQWLRYVQE

GIVE*KRPAATKKAGQAKKKKGS*YPYDVPDYAYPYDVPDYAYPYDVPDYA

18- *Thiomicrospira* sp. XS5 (TsCpf1)

(SEQ ID NO: 43)

MTKTFDSEFFNLYSLQKTVRFELKPVGETASFVEDFKNEGLKRVVSEDERRA

VDYQKVKEIIDDYHRDFIEESLNYFPEQVSKDALEQAFHLYQKLKAAKVEEREKALKEW

EALQKKLREKVVKCFSDSNKARFSRIDKKELIKEDLINWLVAQNREDDIPTVETFNNFTT

YFTGFHENRKNIYSKDDHATAISFRLIHENLPKFFDNVISFNKLKEGFPELKFDKVKEDLE

VDYDLKHAFEIEYFVNFVTQAGIDQYNYLLGGKTLEDGTKKQGMNEQINLFKQQQTRD

KARQIPKLIPLFKQILSERTESQSFIPKQFESDQELFDSLQKLHNNCQDKFTVLQQAILGLA

EADLKKVFIKTSDLNALSNTIFGNYSVFSDALNLYKESLKTKKAQEAFEKLPAHSIHDLIQ

YLEQFNSSLDAEKQQSTDTVLNYFIKTDELYSRFIKSTSEAFTQVQPLFELEALSSKRRPP

ESEDEGAKGQEGFEQIKRIKAYLDTLMEAVHFAKPLYLVKGRKMIEGLDKDQSFYEAFE

MAYQELESLIIPIYNKARSYLSRKPFKADKFKINFDNNTLLSGWDANKETANASILFKKD

GLYYLGIMPKGKTFLFDYFVSSEDSEKLKQRRQKTAEEEALAQDGESYFEKIRYKLLPGA

SKMLPKVFFSNKNIGFYNPSDDILRIRNTASHTKNGTPQKGHSKVEFNLNDCHKMIDFFK

SSIQKHPEWGSFGFTFSDTSDFEDMSAFYREVENQGYVISFDKIKETYIQSQVEQGNLYLF

QIYNKDFSPYSKGKPNLHTLYWKALFEEANLNNVVAKLNGEAEIFFRRHSIKASDKVVH

PANQAIDNKNPHTEKTQSTFEYDLVKDKRYTQDKFFFHVPISLNFKAQGVSKFNDKVNG

FLKGNPDVNIIGIDRGERHLLYFTVVNQKGEILVQESLNTLMSDKGHVNDYQQKLDKKE

QERDAARKSWTTVENIKELKEGYLSHVVHKLAHLIIKYNAIVCLEDLNFGFKRGRFKVE

KQVYQKFEKALIDKLNYLVFKEKELGEVGHYLTAYQLTAPFESFKKLGKQSGILFYVPA

DYTSKIDPTTGFVNFLDLRYQSVEKAKQLLSDFNAIRFNSVQNYFEFEIDYKKLTPKRKV

GTQSKWVICTYGDVRYQNRRNQKGHWETEEVNVTEKLKALFASDSKTTTVIDYANDD

NLIDVILEQDKASFFKELLWLLKLTMTLRHSKIKSEDDFILSPVKNEQGEFYDSRKAGEV

WPKDADANGAYHIALKGLWNLQQINQWEKGKTLNLAIKNQDWFSFIQEKPYQE*KRPAA*

*TKKAGQAKKKKGS*YPYDVPDYAYPYDVPDYAYPYDVPDYA

19- *Moraxella bovoculi* AAX08_00205 (Mb2Cpf1)

(SEQ ID NO: 44)

MLFQDFTHLYPLSKTVRFELKPIGRTLEHIHAKNFLSQDETMADMYQKVKVI

LDDYHRDFIADMMGEVKLTKLAEFYDVYLKFRKNPKDDGLQKQLKDLQAVLRKESVK

PIGSGGKYKTGYDRLFGAKLFKDGKELGDLAKFVIAQEGESSPKLAHLAHFEKFSTYFT

GFHDNRKNMYSDEDKHTAIAYRLIHENLPRFIDNLQILTTIKQKHSALYDQIINELTASGL

DVSLASHLDGYHKLLTQEGITAYNRIIGEVNGYTNKHNQICHKSERIAKLRPLHKQILSD

GMGVSFLPSKFADDSEMCQAVNEFYRHYTDVFAKVQSLFDGFDDHQKDGIYVEHKNL

-continued

NELSKQAFGDFALLGRVLDGYYVDVVNPEFNERFAKAKTDNAKAKLTKEKDKFIKGVH
SLASLEQAIEHHTARHDDESVQAGKLGQYFKHGLAGVDNPIQKIHNNHSTIKGFLERERP
AGERALPKIKSGKNPEMTQLRQLKELLDNALNVAHFAKLLTTKTTLDNQDGNFYGEFG
VLYDELAKIPTLYNKVRDYLSQKPFSTEKYKLNFGNPTLLNGWDLNKEKDNFGVILQKD
GCYYLALLDKAHKKVFDNAPNTGKNVYQKMVYKLLPGPNKMLPKVFFAKSNLDYYN
PSAELLDKYAKGTHKKGDNFNLKDCHALIDFFKAGINKHPEWQHFGFKFSPTSSYRDLS
DFYREVEPQGYQVKFVDINADYIDELVEQGKLYLFQIYNKDFSPKAHGKPNLHTLYFKA
LFSEDNLADPIYKLNGEAQIFYRKASLDMNETTIHRAGEVLENKNPDNPKKRQFVYDIIK
DKRYTQDKFMLHVPITMNFGVQGMTIKEFNKKVNQSIQQYDEVNVIGIDRGERHLLYLT
VINSKGEILEQRSLNDITTASANGTQVTTPYHKILDKREIERLNARVGWGEIETIKELKSG
YLSHVVHQINQLMLKYNAIVVLEDLNFGFKRGRFKVEKQIYQNFENALIKKLNHLVLKD
KADDEIGSYKNALQLTNNFTDLKSIGKQTGFLFYVPAWNTSKIDPETGFVDLLKPRYENI
AQSQAFFGKFDKICYNTDKGYFEFHIDYAKFTDKAKNSRQKWAICSHGDKRYVYDKTA
NQNKGAAKGINVNDELKSLFARYHINDKQPNLVMDICQNNDKEFHKSLMCLLKTLLAL
RYSNASSDEDFILSPVANDEGVFFNSALADDTQPQNADANGAYHIALKGLWLLNELKNS
DDLNKVKLAIDNQTWLNFAQNR*KRPAATKKAGQAKKKKGS*YPYDVPDYAYPYDVPDY*
*AYPYDVPDYA*

20- *Moraxella bovoculi* AAX11_00205 (Mb3Cpf1)
(SEQ ID NO: 45)
MLFQDFTHLYPLSKTVRFELKPIGKTLEHIHAKNFLNQDETMADMYQKVKAI
LDDYHRDFIADMMGEVKLTKLAEFYDVYLKFRKNPKDDGLQKQLKDLQAVLRKEIVK
PIGNGGKYKAGYDRLFGAKLFKDGKELGDLAKFVIAQEGESSPKLAHLAHFEKFSTYFT
GFHDNRKNMYSDEDKHTAIAYRLIHENLPRFIDNLQILATIKQKHSALYDQIINELTASGL
DVSLASHLDGYHKLLTQEGITAYNTLLGGISGEAGSRKIQGINELINSHHNQHCHKSERIA
KLRPLHKQILSDGMGVSFLPSKFADDSEVCQAVNEFYRHYADVFAKVQSLFDGFDDYQ
KDGIYVEYKNLNELSKQAFGDFALLGRVLDGYYVDVVNPEFNERFAKAKTDNAKAKL
TKEKDKFIKGVHSLASLEQAIEHYTARHDDESVQAGKLGQYFKHGLAGVDNPIQKIHNN
HSTIKGFLERERPAGERALPKIKSDKSPEIRQLKELLDNALNVAHFAKLLTTKTTLHNQD
GNFYGEFGALYDELAKIATLYNKVRDYLSQKPFSTEKYKLNFGNPTLLNGWDLNKEKD
NFGVILQKDGCYYLALLDKAHKKVFDNAPNTGKSVYQKMIYKLLPGPNKMLPKVFFA
KSNLDYYNPSAELLDKYAQGTHKKGDNFNLKDCHALIDFFKAGINKHPEWQHFGFKFS
PTSSYQDLSDFYREVEPQGYQVKFVDINADYINELVEQGQLYLFQIYNKDFSPKAHGKP
NLHTLYFKALFSEDNLVNPIYKLNGEAEIFYRKASLDMNETTIHRAGEVLENKNPDNPK
KRQFVYDIIKDKRYTQDKFMLHVPITMNFGVQGMTIKEFNKKVNQSIQQYDEVNVIGID
RGERHLLYLTVINSKGEILEQRSLNDITTASANGTQMTTPYHKILDKREIERLNARVGWG
EIETIKELKSGYLSHVVHQISQLMLKYNAIVVLEDLNFGEKRGRFKVEKQIYQNFENALI
KKLNHLVLKDKADDEIGSYKNALQLTNNFTDLKSIGKQTGFLFYVPAWNTSKIDPETGF
VDLLKPRYENIAQSQAFFGKFDKICYNADRGYFEFHIDYAKFNDKAKNSRQIWKICSHG
DKRYVYDKTANQNKGATIGVNVNDELKSLFTRYHINDKQPNLVMDICQNNDKEFHKSL
MYLLKTLLALRYSNASSDEDFILSPVANDEGVFFNSALADDTQPQNADANGAYHIALKG
LWLLNELKNSDDLNKVKLAIDNQTWLNFAQNR*KRPAATKKAGQAKKKKGS*YPYDVPDY*
*AYPYDVPDYAYPYDVPDYA*

21- *Butyrivibrio* sp. NC3005 (BsCpf1)

(SEQ ID NO: 46)

MYYQNLTKKYPVSKTIRNELIPIGKTLENIRKNNILESDVKRKQDYEHVKGIM

DEYHKQLINEALDNYMLPSLNQAAEIYLKKHVDVEDREEFKKTQDLLRREVTGRLKEH

ENYTKIGKKDILDLLEKLPSISEEDYNALESFRNFYTYFTSYNKVRENLYSDEEKSSTVAY

RLINENLPKFLDNIKSYAFVKAAGVLADCIEEEEQDALFMVETFNMTLTQEGIDMYNYQI

GKVNSAINLYNQKNHKVEEFKKIPKMKVLYKQILSDREEVFIGEFKDDETLLSSIGAYGN

VLMTYLKSEKINIFFDALRESEGKNVYVKNDLSKTTMSNIVFGSWSAFDELLNQEYDLA

NENKKKDDKYFEKRQKELKKNKSYTLEQMSNLSKEDISPIENYIERISEDIEKICIYNGEF

EKIVVNEHDSSRKLSKNIKAVKVIKDYLDSIKELEHDIKLINGSGQELEKNLVVYVGQEE

ALEQLRPVDSLYNLTRNYLTKKPFSTEKVKLNFNKSTLLNGWDKNKETDNLGILFFKDG

KYYLGIMNTTANKAFVNPPAAKTENVFKKVDYKLLPGSNKMLPKVFFAKSNIGYYNPS

TELYSNYKKGTHKKGPSFSIDDCHNLIDFFKESIKKHEDWSKFGFEFSDTADYRDISEFYR

EVEKQGYKLTFTDIDESYINDLIEKNELYLFQIYNKDFSEYSKGKLNLHTLYFMMLFDQR

NLDNVVYKLNGEAEVFYRPASIAENELVIHKAGEGIKNKNPNRAKVKETSTFSYDIVKD

KRYSKYKFTLHIPITMNFGVDEVRRFNDVINNALRTDDNVNVIGIDRGERNLLYVVVINS

EGKILEQISLNSIINKEYDIETNYHALLDEREDDRNKARKDWNTIENIKELKTGYLSQVVN

VVAKLVLKYNAIICLEDLNFGFKRGRQKVEKQVYQKFEKMLIEKLNYLVIDKSREQVSP

EKMGGALNALQLTSKFKSFAELGKQSGIIYYVPAYLTSKIDPTTGFVNLFYIKYENIEKA

KQFFDGFDFIRFNKKDDMFEFSFDYKSFTQKACGIRSKWIVYTNGERIIKYPNPEKNNLF

DEKVINVTDEIKGLFKQYRIPYENGEDIKEIIISKAEADFYKRLFRLLHQTLQMRNSTSDG

TRDYIISPVKNDRGEFFCSEFSEGTMPKDADANGAYNIARKGLWVLEQIRQKDEGEKVN

LSMTNAEWLKYAQLHLL*KRPAATKKAGQAKKKKGS*YPYDVPDYAYPYDVPDYAYPYD*

*VPDYA*

Further Cpf1 orthologs include:
NCBI WP_055225123.1

(SEQ ID NO: 47)

MNNGTNNFQNFIGISSLQKTLRNALIPTETTQQFIVKNGIIKEDELRGENRQILK

DIMDDYYRGFISETLSSIDDIDWTSLFEKMEIQLKNGDNKDTLIKEQTEYRKAIHKKFAN

DDRFKNMFSAKLISDILPEFVIHNNNYSASEKEEKTQVIKLFSRFATSFKDYFKNRANCFS

ADDISSSSCHRIVNDNAEIFFSNALVYRRIVKSLSNDDINKISGDMKDSLKEMSLEEIYSY

EKYGEFITQEGISFYNDICGKVNSFMNLYCQKNKENKNLYKLQKLHKQILCIADTSYEVP

YKFESDEEVYQSVNGFLDNISSKHIVERLRKIGDNYNGYNLDKIYIVSKFYESVSQKTYR

DWETINTALEIHYNNILPGNGKSKADKVKKAVKNDLQKSITEINELVSNYKLCSDDNIKA

ETYIHEISHILNNFEAQELKYNPEIHLVESELKASELKNVLDVIMNAFHWCSVFMTEELV

DKDNNFYAELEEIYDEIYPVISLYNLVRNYVTQKPYSTKKIKLNFGIPTLADGWSKSKEY

SNNAIILMRDNLYYLGIFNAKNKPDKKIIEGNTSENKGDYKKMIYNLLPGPNKMIPKVFL

SSKTGVETYKPSAYILEGYKQNKHIKSSKDFDITFCHDLIDYFKNCIAIHPEWKNFGFDFS

DTSTYEDISGFYREVELQGYKIDWTYISEKDIDLLQEKGQLYLFQIYNKDFSKKSTGNDN

LHTMYLKNLFSEENLKDIVLKLNGEAEIFFRKSSIKNPIIHKKGSILVNRTYEAEEKDQFG

NQIVRKNIPENIYQELYKYFNDKSDKELSDEAAKLKNVVGHHEAATNIVKDYRYTYDK

YFLHMPITINFKANKTGFINDRILQYIAKEKDLHVIGIDRGERNLIYVSVIDTCGNIVEQKS

FNIVNGYDYQIKLKQQEGARQIARKEWKEIGKIKEIKEGYLSLVIHEISKMVIKYNAIIAM

-continued

EDLSYGFKKGRFKVERQVYQKFETMLINKLNYLVFKDISITENGGLLKGYQLTYIPDKLK

NVGHQCGCIFYVPAAYTSKIDPTTGFVNIFKFKDLTVDAKREFIKKFDSIRYDSEKNLFCF

TFDYNNFITQNTVMSKSSWSVYTYGVRIKRRFVNGRFSNESDTIDITKDMEKTLEMTDIN

WRDGHDLRQDIIDYEIVQHIFEIFRLTVQMRNSLSELEDRDYDRLISPVLNENNIFYDSAK

AGDALPKDADANGAYCTALKGLYEIKQITENWKEDGKFSRDKLKISNKDWFDFIQNKR

YL

NCBI WP_055237260.1 (SEQ ID NO: 48)
MNNGTNNFQNFIGISSLQKTLRNALIPTETTQQFIVKNGIIKEDELRGENRQILK

DIMDDYYRGFISETLSSIDDIDWTSLFEKMEIQLKNGDNKDTLIKEQAEKRKAIYKKFAD

DDRFKNMFSAKLISDILPEFVIHNNNYSASEKEEKTQVIKLFSRFATSFKDYFKNRANCFS

ADDISSSSCHRIVNDNAEIFFSNALVYRRIVKNLSNDDINKISGDMKDSLKEMSLDEIYSY

EKYGEFITQEGISFYNDICGKVNSFMNLYCQKNKENKNLYKLRKLHKQILCIADTSYEVP

YKFESDEEVYQSVNGFLDNISSKHIVERLRKIGDNYNGYNLDKIYIVSRFYESVSQKTYR

DWETINTALEIHYNNILPGNGKSKADKVKKAVKNDLQKSITEINELVSNYKLCPDDNIKA

ETYIHEISHILNNFEAQELKYNPEIHLVESELKASELKNVLDVIMNAFHWCSVFMTEELV

DKDNNFYAELEEIYDEIYPVISLYNLVRNYVTQKPYSTKKIKLNFGIPTLADGWSKSKEY

SNNAIILMRDNLYYLGIFNAKNKPDKKIIEGNTSENKGDYKKMIYNLLPGPNKMIPKVFL

SSKTGVETYKPSAYILEGYKQNKHLKSSKDFDITFCRDLIDYFKNCIAIHPEWKNFGFDFS

DTSTYEDISGFYREVELQGYKIDWTYISEKDIDLLQEKGQLYLFQIYNKDFSKKSTGNDN

LHTMYLKNLFSEENLKDIVLKLNGEAEIFFRKSSIKNPIIHKKGSILVNRTYEAEEKDQFG

NIQIVRKTIPENIYQELYKYFNDKSDKELSDEAAKLKNVVGHHEAATNIVKDYRYTYDK

YFLHMPITINFKANKTSFINDRILQYIAKENDLHVIGIDRGERNLIYVSVIDTCGNIVEQKS

FNIVNGYDYQIKLKQQEGARQIARKEWKEIGKIKEIKEGYLSLVIHEISKMVIKYNAIIAM

EDLSYGFKKGRFKVERQVYQKFETMLINKLNYLVFKDISITENGGLLKGYQLTYIPEKLK

NVGHQCGCIFYVPAAYTSKIDPTTGFANIFKFKDLTVDAKREFIKKFDSIRYDSEKNLFCF

TFDYNNFITQNTVMSKSSWSVYTYGVRIKRRFVNGRFSNESDTIDITKDMEKTLEMTDIN

WRDGHDLRQDIIDYEIVQHIFEIFKLTVQMRNSLSELEDRDYDRLISPVLNENNIFYDSAK

AGDALPKDADANGAYCTALKGLYEIKQITENWKEDGKFSRDKLKISNKDWFDFIQNKR

YL

NCBI WP_055272206.1 (SEQ ID NO: 49)
MNNGTNNFQNFIGISSLQKTLRNALTPTETTQQFIVKNGIIKEDELRGENRQIL

KDIMDDYYRGFISETLSSIDDIDWTSLFEKMEIQLKNGDNKDTLIKEQAEKRKAIYKKFA

DDDRFKNMFSAKLISDILPEFVIHNNNYSASEKEEKTQVIKLFSRFATSFKDYFKNRANCF

SADDISSSSCHRIVNDNAEIFFSNALVYRRIVKNLSNDDINKISGDMKDSLKKMSLEKIYS

YEKYGEFITQEGISFYNDICGKVNSFMNLYCQKNKENKNLYKLRKLHKQILCIADTSYEV

PYKFESDEEVYQSVNGFLDNISSKHIVERLRKIGDNYNGYNLDKIYIVSKFYESVSQKTY

RDWETINTALEIHYNNILPGNGKSKADKVKKAVKNDLQKSITEINELVSNYKLCPDDNIK

AETYIHEISHILNNFEAQELKYNPEIHLVESELKASELKNVLDVIMNAFHWCSVFMTEEL

VDKDNNFYAELEEIYDEIYPVISLYNLVRNYVTQKPYSTKKIKLNFGIPTLADGWSKSKE

YSNNAIILMRDNLYYLGIFNAKNKPEKKIIEGNTSENKGDYKKMIYNLLPGPNKMIPKVF

-continued

LSSKTGVETYKPSAYILEGYKQNKHLKSSKDFDITFCRDLIDYFKNCIAIHPEWKNFGFDF

SDTSTYEDISGFYREVELQGYKIDWTYISEKDIDLLQEKGQLYLFQIYNKDFSKKSTGND

NLHTMYLKNLFSEENLKDVVLKLNGEAEIFFRKSSIKNPIIHKKGSILVNRTYEAEEKDQF

GNIQIVRKTIPENIYQELYKYFNDKSDKELSDEAAKLKNAVGHHEAATNIVKDYRYTYD

KYFLHMPITINFKANKTSFINDRILQYIAKEKDLHVIGIDRGERNLIYVSVIDTCGNIVEQK

SFNIVNGYDYQIKLKQQEGARQIARKEWKEIGKIKEIKEGYLSLVIHEISKMVIKYNAIIA

MEDLSYGFKKGRFKVERQVYQKFETMLINKLNYLVFKDISITENGGLLKGYQLTYIPEK

LKNVGHQCGCIFYVPAAYTSKIDPTTGFVNIFKFKDLTVDAKREFIKKFDSIRYDSDKNL

FCFTFDYNNFITQNTVMSKSSWSVYTYGVRIKRRFVNGRFSNESDTIDITKDMEKTLEMT

DINWRDGHDLRQDIIDYEIVQHIFEIFKLTVQMRNSLSELEDRNYDRLISPVLNENNIFYD

SAKAGDALPKDADANGAYCIALKGLYEIKQITENWKEDGKFSRDKLKISNKDWFDFIQN

KRYL

GenBank OLA16049.1
(SEQ ID NO: 50)

MNNGTNNFQNFIGISSLQKTLRNALIPTETTQQFIVKNGIIKEDELRGKNRQIL

KDIMDDYYRGFISETLSSIDDIDWTSLFEKMEIQLKNGDNKDTLIKEQAEKRKAIYKKFA

DDDRFKNMFSAKLISDILPEFVIHNNNYSASEKKEKTQVIKLFSRFATSFKDYFKNRANC

FSADDISSSSCHRIVNDNAEIFFSNALVYRRIVKNLSNDDINKISGDMKDSLKEMSLEEIYS

YEKYGEFITQEGISFYNDICGKVNSFMNLYCQKNKENKNLYKLRKLHKQILCIADTSYEV

PYKFESDEEVYQSVNGFLDNISSKHIVERLRKIGDNYNDYNLDKIYIVSKFYESVSQKTY

RDWETINTALEIHYNNILPGNGKSKADKVKKAVKNDLQKSITEINELVSNYKLCSDDNIK

AETYIHEISHILNNFEAHELKYNPEIHLVESELKASELKNVLDIIMNAFHWCSVFMTEELV

DKDNNFYAELEEIYDEIYPVISLYNLVRNYVTQKPYSTKKIKLNFGIPTLADGWSKSKEY

SNNAIILMRDNLYYLGIFNAKNKPDKKIIEGNTSENKGDYKKMIYNLLPGPNKMIPKVFL

SSKTGVETYKPSAYILEGYKQNKHLKSSKDFDITFCHDLIDYFKNCIAIHPEWKNFGFDFS

DTSAYEDISGFYREVELQGYKIDWTYISEKDIDLLQEKGQLYLFQIYNKDFSKKSTGNDN

LHTMYLKNLFSEENLKDIVLKLNGEAEIFFRKSSIKNPIIHKKGSILVNRTYEAEEKDQFG

NIQIVRKTIPENIYQELYKYFNDKSDKELSDEAAKLKNVVGHHEAATNIVKDYRYTYDK

YFLHMPITINFKANKTSFINDRILQYIAKEKDLHVIGIDRGERNLIYVSVIDTCGNIVEQKS

FNIVNGYDYQIKLKQQEGARQIARKEWKEIGKIKEIKEGYLSLVIHEISKMVIKYNAIIAM

EDLSYGFKKGRFKVERQVYQKFETMLINKLNYLVFKDISITENGGLLKGYQLTYIPDKLK

NVGHQCGCIFYVPAAYTSKIDPTTGFVNIFKFKDLTVDAKREFIKKFDSIRYDSEKNLFCF

TEDYNNFITQNTVMSKSSWSVYTYGVRIKRRFVNGRFSNESDTIDITKDMEKTLEMTDIN

WRDGHDLRQDIIDYEIVQHIFEIFKLTVQMRNSLSELEDRDYDRLISPVLNENNIFYDSAK

AGYALPKDADANGAYCIALKGLYEIKQITENWKEDGKFSRDKLKISNKDWFDFIQNKR

YL

TABLE 4

| Cas13a |
| --- |
| Cas13a orthologs |

| c2c2-5 (SEQ ID NO: 51) | 1 | Lachnospiraceae bacterium MA2020 | MQISKVNHKHVAVGQKDRERITGFIYNDPVGDEKSLEDVVAKRANDTKVLENVF NTKDLYDSQESDKSEKDKEIISKGAKFVAKSENSAITILKKQNKIYSTLTSQQVIKEL KDKEGGARIYDDDIEEALTETLKKSFRKENVRNSIKVLIENAAGIRSSLSKDEEELIQ |

TABLE 4-continued

Cas13a

Cas13a orthologs

| | | | |
|---|---|---|---|
| | | | EYFVKQLVEEYTKTKLQKNVVKSIKNQNMVIQPDSDSQVLSLSESRREKQSSAVSS<br>DTLVNCKEKDVLKAFLTDYAVLDEDERNSLLWKLRNLVNLYFYGSESIRDYSYTK<br>EKSVWKEHDEQKANKTLFIDEICHITKIGKNGKEQKVLDYEENRSRCRKQNINYYR<br>SALNYAKNNTSGIFENEDSNHEWIBLIENEVERLYNGIENGEEFKFETGYISEKVWK<br>AVINHLSIKYIALGKAVYNYAMKELSSPGDIEPGKIDDSYINGITSFDYEIIKAEESLQ<br>RDISMNVVFATNYLACATVDTDKDFLLFSKEDIRSCTKKDGNLCKNIMQFWGGYS<br>TWKNFCEEYLKDDKDALELLYSLKSMLYSMRNSSFHFSTENVDNGSWDTELIGKL<br>FEEDCNRAARIEKEKFYNNNLHMFYSSSLLEKVLERLYSSHHERASQVPSFNRVFV<br>RKNFPSSLSEQRITPKFTDSKDEQIWQSAVYYLCKEIYYNDFLQSKEAYKLFREGV<br>KNLDKNDINNQKAADSFKQAVVYYGKAIGNATLSQVCQAIMTEYNRQNNDGLK<br>KKSAYAEKQNSNKYKHYPLFLKQVLQSAFWEYLDENKEIYGFISAQIHKSNVEIKA<br>EDFIANYSSQQYKKLVDKVKKTPELQKWYTLGRLINPRQANQFLGSIRNYVQFVK<br>DIQRRAKENGNPIRNYYEVLESDSIIKILEMCTKLNGTTSNDIHDYFRDEDEYAEYIS<br>QFVNFGDVHSGAALNAFCNSESEGKKNGIYYDGINPIVNRNWVLCKLYGSPDLISK<br>IISRVNENMIHDFHKQEDLIREYQIKGICSNKKEQQDLRTFQVLKNRVELRDIVEYS<br>EIINELYGQLIKWCYLRERDLMYFQLGFHYLCLNNASSKEADYIKINVDDRNISGAI<br>LYQIAAMYINGLPVYYKKDDMYVALKSGKKASDELNSNEQTSKKINYFLKYGNNI<br>LGDKKDQLYLAGLELFENVAEHENIIIERNEIDHEHYFYDRDRSMLDLYSEVFDRFF<br>TYDMKLRKNVVNMLYNILLDHNIVSSFVFETGEKKVGRGDSEVIKPSAKIRLRAN<br>NGVSSDVETYKVGSKDELKIATLPAKNEEFLLNVARLIYYPDMEAVSENMVREGV<br>VKVEKSNDKKGKISRGSNTRSSNQSKYNNKSKNRMNYSMGSIFEKMDLKFD |
| c2c2-6<br>(SEQ ID<br>NO: 52) | 2 | *Lachnospiraceae bacterium* NK4A179 | MKISKVREENRGAKLTVNAKTAVVSENRSQEGILYNDPSRYGKSRKNDEDRDYI<br>ESRLKSSGKLYRIFNEDKNKRETDELQWFLSEIVKKINRRNGLVLSDMLSVDDRAF<br>EKAFEKYAELSYTNRRNKVSGSPAFETCGVDAATAERLKGIISETNFINRIKNNIDN<br>KVSEDIIDRIIAKYLKKSLCRERVKRGLKKLLMNAFDLPYSDPDIDVQRDFIDYVLE<br>DFYHVRAKSQVSRSIKNMNMPVQPEGDGKFAITVSKGGTESGNKRSAEKEAPKKF<br>LSDYASLDERVRDDMLRRMRRLVVLYFYGSDDSKLSDVNEKFDVWEDHAARRV<br>DNREFIKLPLENKLANGKTDKDAERIRKNTVKELYRNQNIGCYRQAVKAVEEDNN<br>GRYFDDKMLNMFFIHRIEYGVEKIYANLKQVTEFKARTGYLSEKIWKDLINYISIK<br>YIAMGKAVYNYAMDELNASDKKEIELGKISEEYLSGISSFDYELIKAEEMLQRETA<br>VYVAFAARHLSSQTVELDSENSDELLLKPKGTMDKNDKNKLASNNILNELKDKET<br>LRDTILQYFGGHSLWTDFPFDKYLAGGKDDVDFLTDLKDVIYSMRNDSFHYATEN<br>HNNGKWNKELISAMFEHETERMTVVMKDKEYSNNLPMFYKNDDLKKLLIDLYK<br>DNVERASQVPSENKVEVRKNEPALVRDKDNLGIELDLKADADKGENELKEYNAL<br>YYMFKEIYYNAFLNDKNVRERFITKATKVADNYDRNKERNLKDRIKSAGSDEKK<br>KLREQLQNYIAENDFGQRIKNIVQVNPDYTLAQICQLIMTEYNQQNNGCMQKKSA<br>ARKDINKDSYQHYKMLLLVNLRKAFLEFIKENYAFVLKPYKHDLCDKADFVPDFA<br>KYVKPYAGLISRVAGSSELQKWYIVSRFLSPAQANHMLGFLHSYKQYVWDIYRRA<br>SETGTEINHSIAEDKIAGVDITDVDAVIDLSVKLCGTISSEISDYFKDDEVYAEYISSY<br>LDFEYDGGNYKDSLNRFCNSDAVNDQKVALYYDGEHPKLNRNIILSKLYGERRFL<br>EKITDRVSRSDIVEYYKLKKETSQYQTKGIFDSEDEQKNIKKFQEMKNIVEFRDLM<br>DYSEIADELQGQLINWIYLRERDLMNFQLGYHYACLNNDSNKQATYVTLDYQGK<br>KNRKINGAILYQICAMYINGLPLYYVDKDSSEWTVSDGKESTGAKIGEFYRYAKSF<br>ENTSDCYASGLEIFENISEHDNITELRNYIEHFRYYSSFDRSFLGIYSEVEDREFTYDL<br>KYRKNVPTILYNILLQHFVNVRFEFVSGKKMIGIDKKDRKIAKEKECARITIREKNG<br>VYSEQFTYKLKNGTVYVDARDKRYLQSIIRLLFYPEKVNMDEMIEVKEKKKPSDN<br>NTGKGYSKRDRQQDRKEYDKYKEGNFLSGMGGNINWDEINAQLKN |
| c2c2-7<br>(SEQ ID<br>NO: 53) | 3 | [*Clostridium*] *aminophilum* DSM 10710 | MKFSKVDHTRSAVGIQKATDSVHGMLYTDPKKQEVNDLDKRFDQLNVKAKRLY<br>NVFNQSKAEEDDDEKRFGKVVKKLNRELKDLLFHREVSRYNSIGNAKYNYYGIKS<br>NPEEIVSNLGMVESLKGERDPQKVISKLLLYYLRKGLKPGTDGLRMILEASCGLRK<br>LSGDEKELKVFLQTLDEDFEKKTFKKNLIRSIENQNMAVQPSNEGDPIIGITQGRFN<br>SQKNEEKSAIERMIVISMYADLNEDHREDVLRKLRRLNVLYFNVDTEKTEEPTLPGE<br>VDTNPVFEVWHDHEKGKENDRQFATFAKILTEDRETRKKEKLAVKEALNDLKSAI<br>RDHNIMAYRCSIKVTEQDKDGLFFEDQRINREWIHHIESAVERILASINPEKLYKLRI<br>GYLGEKVWKDLLNYLSIKYIAVGKAVEHFAMEDLGKTGQDIELGKLSNSVSGGLT<br>SFDYEQIRADETLQRQLSVEVAFAANNLFRAVVGQTGKKIEQSKSEENEEDFLLW<br>KAEKIAESIKKEGEGNTLKSILQFFGGASSWDLNHFCAAYGNESSALGYETKFADD<br>LRKAIYSLRNETFHETTLNKGSFDWNAKLIGDMFSHEAATGIAVERTRFYSNNLPM<br>EYRESDLKRIMDHLYNTYHPRASQVPSENTSVEVRKNERLFLSNTLNTNTSFDTEVY<br>QKWESGVYYLFKEIYYNSFLPSGDAHHLFFEGLRRIRKEADNLPIVGKEAKKRNAV<br>QDFGRRCDELKNLSLSAICQMIMTEYNEQNNGNRKVKSTREDKRKPDIFQHYKML<br>LLRTLQEAFAIYIRREEPFKFIFDLPKTLYVMKPVEEFLPNWKSGMFDSLVERVKQSP<br>DLQRWYVLCKFLNGRLLNQLSGVIRSYIQFAGDIQRRAKANHNRLYMDNTQRVE<br>YYSNVLEVVDFCIKGTSRFSNVFSDYFRDEDAYADYLDNYLQFKDEKIAEVSSFAA<br>LKTFCNEEEVKAGIYMDGENPVMQRNIVMAKLFGPDEVLKNVVPKVTREEIEEYY<br>QLEKQIAPYRQNGYCKSEEDQKKLLREQRIKNRVEFQTITEFSEIINELLGQLISWSF<br>LRERDLLYFQLGFHYLCLHNDTEKPAEYKEISREDGTVIRNAILHQVAAMYVGGLP<br>VYTLADKKLAAFEKGEADCKLSISKDTAGAGKKIKDFFRYSKYVIIKDRMLTDQN<br>QKYTIYLAGLELFENTDEHDNITDVRKYVDHFKYYATSDENAMSILDLYSEIHDRF<br>FTYDMKYQKNVANMLENILLRHEVLIRPEFFTGSKKVGEGKKITCKARAQIEIAEN<br>GMRSEDFTYKLSDGKKNISTCMIAARDQKYLNTVARLLYYPHEAKKSIVDTREKK<br>NNKKTNRGDGTENKQKGTARKEKDNGPREENDTGFSNTPFAGFDPFRNS |

TABLE 4-continued

Cas13a

Cas13a orthologs

| | | | |
|---|---|---|---|
| c2c2-8 (SEQ ID NO: 54) | 5 | Carnobacterium gallinarum DSM 4847 | MRITKVKIKLDNKLYQVTMQKEEKYGTLKLNEESRKSTAEILRLKKASFNKSFHSK TINSQKENKNATIKKNGDYISQIFEKLVGVDTNKNIRKPKMSLTDLKDLPKKDLAL FIKRKEKNDDIVEIKNLDLISLEYNALQKVPGEHETDESWADFCQEMMPYREYKNK FIERKIILLANSIEQNKGFSINPETFSKKRVLHQWAIEVQERGDFSILDEKLSKLAEI YNFKKMCKRVQDELNDLEKSMKKGKNPEKEKEAYKKQKNFKIKTIWKDYPYKT HIGLIEKIKENEELNQFNIEIGKYFEHYFPIKKERCTEDEPYYLNSETIATTVNYQLK NALISYLMQIGKYKQFGLENQVLDSKKLQEIGIYEGFQTKFMDACVFATSSLKNIIE PMRSGDILGKREFKEAIATSSEVNYHHFFPYFPFELKGMKDRESELIPFGEQTEAKQ MQNIWALRGSVQQIRNEIFHSFDKNQKFNLPQLDKSNFEFDASENSTGKSQSYIET DYKELFEAEKNQLEQFFIERIKSSGALEYYPLKSLEKLFAKKEMKESLGSQVVAFAP SYKKLVKKGHSYQTATEGTANYLGLSYYNRYELKEESFQAQYYLLKLIYQYVFLP NESQGNSPAFRETVKAILRINKDEARKKMKKNKKFLRKYAFEQVREMEEKETPDQ YMSYLQSEMREEKVRKAEKNDKGFEKNITMNFEKLLMQIFVKGEDVFLTTFAGKE LLLSSEEKVIKETEISLSKKINEREKTLKASIQVEHQLVATNSAISYWLFCKLLDSRH LNELRNEMIKFKQSRIKENHTQHAELIQNLLPIVELTILSNDYDEKNDSQNVDVSAY FEDKSLYETAPYVQTDDRTRVSFRPILKLEKYHTKSLIEALLKDNPQFRVAATDIQE WMHKREEIGELVEKRKNLHTEWAEGQQTLGAEKREEYRDYCKKIDRENWKANK VTLTYLSQLHYLITDLLGRMVGFSALFERDLVYFSRSFSELGGETYHISDYKNLSGV LRLNAEVKPIKIKNIKVIDNEENPYKGNEPEVKPFLDRLHAYLENVIGIKAVHGKIR NQTAHLSVLQLELSMIESMNNLRDLMAYDRKLKNAVTKSMIKILDKHGMILKLKI DENHKNFEIESLIPKEIIHLKDKAIKTNQVSEEYCQLVLALLTTNPGNQLN |
| c2c2-9 (SEQ ID NO: 55) | 6 | Carnobacterium gallinarum DSM 4847 | MRMTKVKINGSPVSMNRSKLNGHLVWNGTTNTVNILTKKEQSFAASFLNKTLVK ADQVKGYKVLAENIFIIFEQLEKSNSEKPSVYLNNIRRLKEAGLKRFFKSKYHEEIK YTSEKNQSVPTKLNLIPLFFNAVDRIQEDKFDKNWSYFCKEMSPYLDYKKSYLNR KKEILANSIQQNRGFSMPTAEEPNLLSKRKQLFQQWAMKFQESPLIQQNNFAVEQF NKEFANKINELAAVYNVDELCTAITEKLMNFDKDKSNKTRNFEIKKLWKQHPHNK DKALIKLFNQEGNEALNQFNIELGKYFEHYFPKTGKKESAESYYLNPQTIIKTVGY QLRNAFVQYLLQVGKLHQYNKGVLDSQTLQEIGMYEGFQTKFMDACVFASSSLR NIIQATTNEDILTREKFKKELEKNVELKHDLEFKTEIVEERDENPAKKIAMTPNELD LWAIRGAVQRVRNQIFHQQINKRHEPNQLKVGSFENGDLGNVSYQKTIYQKLFDA EIKDIEIYFAEKIKSSGALEQYSMKDLEKLFSNKELTLSLGGQVVAFAPSYKKLYKQ GYFYQNEKTIELEQFTDYDFSNDVFKANYYLIKLIYHYVFLPQFSQANNKLFKDTV HYVIQQNKELNTTEKDKKNNKKIRKYAFEQVKLMKNESPEKYMQYLQREMQEER TIKEAKKTNEEKPNYNFEKLLIQIFIKGFDTFLRNFDLNLNPAEELVGTVKEKAEGL RRKERIAKILNVDEQIKTGDEEIAFWIFAKLLDARHLSELRNEMIKFKQSSVKKGL IKNGDLIEQMQPILELCILSNDSESMEKESEDKIEVFLEKVELAKNEPYMQEDKLTP VKPRFMKQLEKYQTRNFIENLVIENPEEKVSEKIVLNWHEEKEKIADLVDKRTKLH EEWASKAREIEEYNEKIKKNKSKKLDKPAEFAKFAEYKIICEAIENENRLDHKVRLT YLKNLHYLMIDLMGRMVGFSVLFERDFVYMGRSYSALKKQSIYLNDYDTFANIRD WEVNENKHLFGTSSSDLTFQETAEFKNLKKPMENQLKALLGVTNHSFEIRNNIAHL HVLRNDGKGEGVSLLSCMNDLRKLMSYDRKLKNAVTKAIIKILDKHGMILKLTNN DHTKPFEIESLPKKIIHLEKSNHSFPMDQVSQEYCDLVKKMLVFTN |
| c2c2-10 (SEQ ID NO: 56) | 7 | Paludibacter propionicigenes WB4 | MRVSKVKVKDGGKDKMVLVHRKTTGAQLVYSGQPVSNETSNILPEKKRQSFDLS TLNKTIIKEDTAKKQKLNVDQYKIVEKIFKYPKQELPKQIKAEEILPFLNHKFQEPV KYWKNGKEESFNLTLLIVEAVQAQDKRKLQPYYDWKTWYIQTKSDLLKKSIENN RIDLTENLSKRKKALLAWETEFTASGSIDLTHYHKVYMTDVLCKMLQDVKPLTDD KGKINTNAYHRGLKKALQNHQPAIFGTREVPNEANRADNQLSIYHLEVVKYLEHY FPIKTSKRRNTADDIAHYLKAQTLKTTIEKQLVNAIRANIIQQGKTNHHELKADTTS NDLIRIKTNEAFVLNLTGTCAFAANNIRNMVDNEQTNDILGKGDFIKSLLKDNTNS QLYSEFFGEGLSTNKAEKETQLWGIRGAVQQIRNNVNHYKKDALKTVFNISNFENP TITDPKQQTNYADTIYKARFINELEKIPEAFAQQLKTGGAVSYYTIENLKSLLTTFQF SLCRSTIPPAPGEKKVENGGINYQNAKQDESFYELMLEQYLRKENFAEESYNARYF MLKLIYNNLFLPGETTDRKAFADSVGFVQMQNKKQAEKVNPRKKEAYAFEAVRP MTAADSIADYMAYVQSELMQEQNKKEEKVAEETRINFEKEVLQVFIKGEDSFLRA KEFDEVQMPQPQLTATASNQQKADKLNQLEASITADCKLTPQYAKADDATHIAFY VFCKLLDAAHLSNRLNELIKFRESVNEFKEHHLLEIIEICLLSADVVPTDYRDLYSSE ADCLARLRPFIEQGADITNWSDLFVQSDKHSPVIHANIELSVKYGTTKLLEQIINKD TQFKTTEANFTAWNTAQKSIEQLIKQREDHHEQWVKAKNADDKEKQERKREKSN FAQKFIEKHGDDYLDICDYINTYNWLDNKMEIFVHLNRLHGLTIELLGRMAGEVAL FDRDFQFFDEQQIADEFKLHGEVNLHSIDKKLNEVPTKKIKEIYDIRNKIIQINGNKI NESVRANLIQFISSKRNYYNNAFLHVSNDEIKEKQMYDIRNHIAHENYLTKDAADF SLIDLINELRELLHYDRKLKNAVSKAFIDLEDKHGMILKLKLNADHKLKVESLEPK KIYHLGSSAKDKPEYQYCTNQVMMAYCNMCRSLLEMKK |
| c2c2-11 (SEQ ID NO: 57) | 9 | Listeria weihenstephan- ensis FSL R9- 0317 | MLALLHQEVPSQKLHNLKSLNTESLTKLFKPKFQNMISYPPSKGAEHVQFCLTDIA VPAIRDLDEIKPDWGIFFEKLKPYTDWAESYIHYKQTTIQKSIEQNKIQSPDSPRKLV LQKYVTAFLNGEPLGLDVAKKYKLADLAESEKVVDLNEDKSANYKIKACLQQH QRNILDELKEDPELNQYGIEVKKYIQRYFPIKRAPNRSKHARADFLKKELIESTVEQ QPFKNAVYHYVLEQGKMEAYELTDPKTKDLQDIRSGEAFSFKFINACAFASNNLKM ILNPECEKDILGKGDFKKNLPNSTTQSDVVKKMIPFFSDEIQNVNEDEAIWAIRGSIQ QIRNEVYHCKKHSWKSILKIKGFEFEPNNMKYTDSDMQKLMDKDIAKIPDFIEEKL KSSGIIRFYSHDKLQSIWEMKQGFSLLTTNAPFVPSFKRVYAKGHDYQTSKNRYYD LGLTTEDILEYGEEDFRARYFLTKLVYYQQEMPWFTADNNAFRDAANFVLRLNKN RQQDAKAFINIREVEEGEMPRDYMGYVQGQIAIHEDSTEDTPNHFEKFISQVFIKGF |

TABLE 4-continued

Cas13a

Cas13a orthologs

| | | | |
|---|---|---|---|
| | | | DSHMRSADLKFIKNPRNQGLEQSEIEEMSFDIKVEPSFLKNKDDYIAFWTFCKMLD ARHLSELRNEMIKYDGHLTGEQEIIGLALLGVDSRENDWKQFFSSEREYEKIMKGY VGEELYQREPYRQSDGKTPILFRGVEQARKYGTETVIQRLFDASPEFKVSKCNITE WERQKETIEETIERRKELHNEWEKNPKKPQNNAFFKEYKECCDAIDAYNWHKNK TTLVYVNELHHLLIEILGRYVGYVAIADRDFQCMANQYFKHSGITERVEYWGDNR LKSIKKLDTELKKEGLEVSEKNARNHIAHLNYLSLKSECTLLYLSERLREIFKYDRK LKNAVSKSLIDILDRHGMSVVFANLKENKHRLVIKSLEPKKLRHLGEKKIDNGYIE TNQVSEEYCGIVKRLLEI |
| c2c2-12 (SEQ ID NO: 58) | 10 | Listeriaceae bacterium FSL M6-0635 = Listeria newyorkensis FSL M6-0635 | MKITKMRVDGRTIVMERTSKEGQLGYEGIDGNKTTEIIFDKKKESFYKSILNKTVR KPDEKEKNRRKQAINKAINKEITELMLAVLHQEVPSQKLHNLKSLNTESLTKLFKP KFQNMISYPPSKGAEHVQFCLTDIAVPAIRDLDEIKPDWGIFFEKLKPYTDWAESYI HYKQTTIQKSIEQNKIQSPDSPRKLVLQKYVTAFLNGEPLGLDLVAKKYKLADLAE SFKLVDLNEDKSANYKIKACLQQHQRNILDELKEDPELNQYGIEVKKYIQRYFPIK RAPNRSKHARADFLKKELISTVEQQFKNAVYHYVLEQGKMEAYELTDPKTKDL QDIRSGEAFSFKFINACAFASNNLKMILNPECEKDILGKGNFKKNLPNSTTRSDVVK KMIPFFSDELQNVNEDEAIWAIRGSIQQIRNEVYHCKKHSWKSILKIKGFEFEPNNM KYADSDMQKLMDKDIAKIPEFIEEKLKSSGVVRFYRHDELQSIWEMKQGFSLLTTN APFVPSFKRVYAKGHDYQTSKNRYYNLDLTTFDILEYGEEDFRARYFLTKLVYYQ QEMPWFTADNNAFRDAANFVLRLNKNRQQDAKAFINIREVEEGEMPRDYMGYV QGQIAIHEDSIEDTPNHFEKFISQVFIKGFDRHMRSANLKFIKNPRNQGLEQSEIEEM SFDIKVEPSELKNKDDYIAFWIECKMLDARHLSELRNEMIKYDGHLTGEQEIIGLAL LGVDSRENDWKQFFSSEREYEKIMKGYVVEELYQREPYRQSDGKTPILFRGVEQA RKYGTETVIQRLFDANPEEKVSKCNLAEWERQKETIEETIKRRKELHNEWAKNPK KPQNNAFFKEYKECCDAIDAYNWHKNKTTLAYVNELHHLLIEILGRYVGYVAIAD RDFQCMANQYFKHSGITERVEYWGDNRLKSIKKLDTFLKKEGLEVSEKNARNHIA HLNYLSLKSECTLLYLSERLREIFKYDRKLKNAVSKSLIDILDRHGMSVVFANLKE NKHRLVIKSLEPKKLRHLGGKKIDGGYIETNQVSEEYCGIVKRLLEM |
| c2c2-13 (SEQ ID NO: 59) | 12 | Leptotrichia wadei F0279 | MKVTKVDGISHKKYIEEGKLVKSTSEENRTSERLSELLSIRLDIYIKNPDNASEEENR IRRENLKKFFSNKVLHLKDSVLYLKNRKEKNAVQDKNYSEEDISEYDLKNKNSFS VLKKILLNEDVNSEELEIFRKDVEAKLNKINSLKYSFEENKANYQKINENNVEKVG GKSKRNITYDYYRESAKRNDYINNVQEAFDKLYKKEDIEKLEFLIENSKKHEKYKIR EYYHKIIGRKNDKENFAKIIYEEIQNVNNIKELIEKIPDMSELKKSQVFYKYYLDKE ELNDKNIKYAFCHFVEIEMSQLLKNYVYKRLSNISNDKIKRIFEYQNLKKLIENKLL NKLDTYVRNCGKYNYYLQVGEIATSDFIARNRQNEAFLRNIIGVSSVAYFSLRNILE TENENDITGRMRGKTVKNNKGEEKYVSGEVDKIYNENKQNEVKENLKMFYSDF NMDNKNEIEDFFANIDEATSSIRHGIVHFNLELEGKDIFAFKNIAPSEISKKMFQNEIN EKKLKLKIFKQLNSANVENYYEKDVIIKYLKNTKENEVNKNIPFVPSFTKLYNKIED LRNTLKFEWSVPKDKEEKDAQIYLLKNIYYGEFLNKFVKNSKVFFKITNEVIKINKQ RNQKTGHYKYQKFENIEKTVPVEYLAIIQSREMINNQDKEEKNTYIDFIQQIFLKGFI DYLNKNNLKYIESNNNNDNNDIFSKIKIKKDNKEKYDKILKNYEKHNRNKEIPHEI NEFVREIKLGKILKYTENLNMFYLILKLLNHKELTNLKGSLEKYQSANKEETFSDEL ELINLLNLDNNRVTEDFELEANEIGKELDFNENKIKDRKELKKEDTNKIYEDGENII KHRAFYNIKKYGMLNLLEKIADKAKYKISLKELKEYSNKKNEIEKNYTMQQNLHR KYARPKKDEKENDEDYKEYEKAIGNIQKYTHLKNKVEFNELNLLQGLLLKILHRL VGYTSIWERDLRFRLKGEFPENHYIEEIFNEDNSKNVKYKSGQIVEKYINFYKELYK DNVEKRSIYSDKKVKKLKQEKKDLYIRNYIAHENYIPHAEISLLEVLENLRKLLSYD RKLKNAIMKSIVDILKEYGEVATFKIGADKKIEIQTLESEKIVHLKNLKKKKLMTDR NSEELCELVKVMFEYKALE |
| c2c2-14 (SEQ ID NO: 60) | 15 | Rhodobacter capsulatus SB 1003 | MQIGKVQGRTISEFGDPAGGLKRKISTDGKNRKELPAHLSSDPKALIGQWISGIDKI YRKPDSRKSDGKAIHSPTPSKMQFDARDDLGEAFWKLVSEAGLAQDSDYDQFKR RLHPYGDKFQPADSGAKLKFEADPPEPQAFHGRWYGAMSKRGNDAKELAAALYE HLHVDEKRIDGQPKRNPKTDKFAPGLVVARALGIESSVLPRGMARLARNWGEEEI QTYFVVDVAASVKEVAKAAVSAAQAFDPPRQVSGRSLSPKVGFALAEHLERVTGS KRCSFDPAAGPSVLALHDEVKKTYKRLCARGKNAARAFPADKTELLALMRHTHE NRVRNQMVRMGRVSEYRGQQAGDLAQSHYWTSAGQTEIKESEIFVRLWVGAFAL AGRSMKAWIDPMGKIVNTEKNDRDLTAAVNIRQVISNKEMVAEAMARRGIYFGE TPELDRLGAEGNEGFVFALLRYLRGCRNQTFHLGARAGELKEIRKELEKTRWGKA KEAEHVVLTDKTVAAIRAIIDNDAKALGARLLADLSGAFVAHYASKEHESTLYSEI VKAVKDAPEVSSGLPRLKLLLKRADGVRGYVHGLRDTRKHAFATKLPPPPAPREL DDPATKARYIALLRLYDGPFRAYASGITGTALAGPAARAKEAATALAQSVNVTKA YSDVMEGRTSRLRPPNDGETLREYLSALTGETATEFRVQIGYESDSENARKQAEFI ENYRRDMLAFMFEDYIRAKGEDWILKIEPGATAMTRAPVLPEPIDTRGQYEHWQA ALYLVMHFVPASDVSNLLHQLRKWEALQGKYELVQDGDATDQADARREALDLV KRERDVLVLELKTGEARFEGRAAPFDLKPFRALFANPATEDRLFMATPTTARPAED DPEGDGASEPELRVARTLRGLRQIARYNHMAVLSDLFAKHKVRDEEVARLAEIED ETQEKSQIVAAQELRTDLHDKVMKCHPKTISPEERQSYAAAIKTIEEHRFLVGRVY LGDHLRLHRLMMDVIGRLIDYAGAYERDTGTFLINASKQLGAGADWAVTIAGAA NTDARTQTRKDLAHENVLDRADGTPDLTALVNRAREMMAYDRKRKNAVPRSILD MLARLGLTLKWQMKDHLLQDATITQAAIKHLDKVRLTVGGPAAVTEARFSQDYL QMVAAVFNGSVQNPKPRRRDDGDAWHKPPKPATAQSQPDQKPPNKAPSAGSRLP PPQVGEVYEGVVVKVIDTGSLGFLAVEGVAGNIGLHISRLRRIREDAIIVGRRYRFR VEIYVPPKSNTSKLNAADLVRID |

TABLE 4-continued

Cas13a

Cas13a orthologs

| c2c2-15 (SEQ ID NO: 61) | 16 | *Rhodobacter capsulatus* R121 | MQIGKVQGRTISEFGDPAGGLKRKISTDGKNRKELPAHLSSDPKALIGQWISGIDKI<br>YRKPDSRKSDGKAIHSPTPSKMQFDARDDLGEAFWKLVSEAGLAQDSDYDQFKR<br>RLHPYGDKFQPADSGAKLKFEADPPEPQAFHGRWYGAMSKRGNDAKELAAALYE<br>HLHVDEKRIDGQPKRNPKTDKFAPGLVVARALGIESSVLPRGMARLARNWGEEEI<br>QTYFVVDVAASVKEVAKAAVSAAQAFDPPRQVSGRSLSPKVGFALAEHLERVTGS<br>KRCSFDPAAGPSVLALHDEVKKTYKRLCARGKNAARAFPADKTELLALMRHTHE<br>NRVRNQMVRMGRVSEYRGQQAGDLAQSHYWTSAGQTEIKESEIFVRLWVGAFAL<br>AGRSMKAWIDPMGKIVNTEKNDRDLTAAVNIRQVISNKEMVAEAMARRGIVEGE<br>TPELDRLGAEGNEGFVFALLRYLRGCRNQTFHLGARAGELKEIRKELEKTRWGKA<br>KEAEHVVLTDKTVAAIRAIIDNDAKALGARLLADLSGAFVAHYASKEHFSTLYSEI<br>VKAVKDAPEVSSGLPRLKLLLKRADGVRGYVHGLRDTRKHAFATKLPPPPAPREL<br>DDPATKARYIALLRLYDGPFRAYASGITGTALAGPAARAKEAATALAQSVNVTKA<br>YSDVMEGRSSRLRPPNDGETLREYLSALTGETATEFRVQIGYESDSENARKQAEFIE<br>NYRRDMLAFMFEDYIRAKGEDWILKIEPGATAMTRAPVLPEPIDTRGQYEHWQAA<br>LYLVMHFVPASDVSNLLHQLRKWEALQGKYELVQDGDATDQADARREALDLVK<br>RFRDVLVLFLKTGEARFEGRAAPFDLKPFRALFANPATFDRLFMATPTTARPAEDD<br>PEGDGASEPELRVARTLRGLRQIARYNHMAVLSDLFAKHKVRDEEVARLAEIEDE<br>TQEKSQIVAAQELRTDLHDKVMKCHPKTISPEERQSYAAAIKTIEEHRFLVGRVYL<br>GDHLRLHRLMMDVIGRLIDYAGAYERDTGTFLINASKQLGAGADWAVTIAGAAN<br>TDARTQTRKDLAHENVLDRADGTPDLTALVNRAREMMAYDRKRKNAVPRSILD<br>MLARLGLTLKWQMKDHLLQDATITQAAIKHLDKVRLTVGGPAAVTEARFSQDYL<br>QMVAAVFNGSVQNPKPRRRDDGDAWHKPPKPATAQSPDQKPPNKAPSAGSRLP<br>PPQVGEVYEGVVVKVIDTGSLGFLAVEGVAGNIGLHISRLRRIREDAIIVGRRYRFR<br>VEIYVPPKSNTSKLNAADLVRID |
| c2c2-16 (SEQ ID NO: 62) | 17 | *Rhodobacter capsulatus* DE442 | MQIGKVQGRTISEFGDPAGGLKRKISTDGKNRKELPAHLSSDPKALIGQWISGIDKI<br>YRKPDSRKSDGKAIHSPTPSKMQFDARDDLGEAFWKLVSEAGLAQDSDYDQFKR<br>RLHPYGDKFQPADSGAKLKFEADPPEPQAFHGRWYGAMSKRGNDAKELAAALYE<br>HLHVDEKRIDGQPKRNPKTDKFAPGLVVARALGIESSVLPRGMARLARNWGEEEI<br>QTYFVVDVAASVKEVAKAAVSAAQAFDPPRQVSGRSLSPKVGFALAEHLERVTGS<br>KRCSFDPAAGPSVLALHDEVKKTYKRLCARGKNAARAFPADKTELLALMRHTHE<br>NRVRNQMVRMGRVSEYRGQQAGDLAQSHYWTSAGQTEIKESEIFVRLWVGAFAL<br>AGRSMKAWIDPMGKIVNTEKNDRDLTAAVNIRQVISNKEMVAEAMARRGIVEGE<br>TPELDRLGAEGNEGFVFALLRYLRGCRNQTFHLGARAGELKEIRKELEKTRWGKA<br>KEAEHVVLTDKTVAAIRAIIDNDAKALGARLLADLSGAFVAHYASKEHFSTLYSEI<br>VKAVKDAPEVSSGLPRLKLLLKRADGVRGYVHGLRDTRKHAFATKLPPPPAPREL<br>DDPATKARYIALLRLYDGPFRAYASGITGTALAGPAARAKEAATALAQSVNVTKA<br>YSDVMEGRSSRLRPPNDGETLREYLSALTGETATEFRVQIGYESDSENARKQAEFIE<br>NYRRDMLAFMFEDYIRAKGEDWILKIEPGATAMTRAPVLPEPIDTRGQYEHWQAA<br>LYLVMHFVPASDVSNLLHQLRKWEALQGKYELVQDGDATDQADARREALDLVK<br>RFRDVLVLFLKTGEARFEGRAAPFDLKPFRALFANPATFDRLFMATPTTARPAEDD<br>PEGDGASEPELRVARTLRGLRQIARYNHMAVLSDLFAKHKVRDEEVARLAEIEDE<br>TQEKSQIVAAQELRTDLHDKVMKCHPKTISPEERQSYAAAIKTIEEHRFLVGRVYL<br>GDHLRLHRLMMDVIGRLIDYAGAYERDTGTFLINASKQLGAGADWAVTIAGAAN<br>TDARTQTRKDLAHENVLDRADGTPDLTALVNRAREMMAYDRKRKNAVPRSILD<br>MLARLGLTLKWQMKDHLLQDATITQAAIKHLDKVRLTVGGPAAVTEARFSQDYL<br>QMVAAVFNGSVQNPKPRRRDDGDAWHKPPKPATAQSPDQKPPNKAPSAGSRLP<br>PPQVGEVYEGVVVKVIDTGSLGFLAVEGVAGNIGLHISRLRRIREDAIIVGRRYRFR<br>VEIYVPPKSNTSKLNAADLVRID |
| c2c2-2 (SEQ ID NO: 63) | | | MGNLFGHKRWYEVRDKKDFKIKRKVKVRNYDGNKYILNINENNNKEKIDNNKF<br>IRKYINYKKNDNILKEFTRKFHAGNILFKLKGKEGIIRIENNDDFLETEEVVLYIEAY<br>GKSEKLKALGITKKKIIDEAIRQGITKDDKKIEIKRQENEEEIEIDIRDEYTNKTLNDC<br>SIILRIIENDELETKKSIYEIFKNINMSLYKIIEKIIENETEKVFENRYYEEHLREKLLK<br>DDKIDVILTNEMEIREKIKSNLEILGFVKFYLNVGGDKKKSKNKKMLVEKILNINVD<br>LTVEDIADFVIKELEFWNITKRIEKVKKVNNEFLEKRRNRTYIKSYVLLDKHEKFKI<br>ERENKKDKIVKFFVENIKNNSIKEKIEKILAEFKIDELIKKLEKELKKGNCDTEIFGIF<br>KKHYKVNFDSKKFSKKSDEEKELYKIIYRYLKGRIEKILVNEQKVRLKKMEKIEIEK<br>ILNESILSEKILKRVKQYTLEHIMYLGKLRHNDIDMTTVNTDDFSRLHAKEELDLEL<br>ITFFASTNMELNKIFSRENINNDENIDFFGGDREKNYVLDKKILNSKIKIIRDLDFIDN<br>KNNITNNFIRKFTKIGTNERNRILHAISKERDLQGTQDDYNKVINIIQNLKISDEEVS<br>KALNLDVVFKDKKNIITKINDIKISEENNNDIKYLPSFSKVLPEILNLYRNNPKNEPF<br>DTIETEKIVLNALIYVNKELYKKLILEDDLEENESKNIFLQELKKTLGNIDEIDENIIE<br>NYYKNAQISASKGNNKAIKKYQKKVIECYIGYLRKNYEELFDFSDFKMNIQEEIKKQ<br>IKDINDNKTYERITVKTSDKTIVINDDFEYIISIFALLNSNAVINKIRNRFFATSVWLN<br>TSEYQNIIDILDEIMQLNTLRNECITENWNLNLEEFIQKMKEIEKDFDDFKIQTKKEI<br>FNNYYEDIKNNILTEFKDDINGCDVLEKKLEKIVIFDDETKFEIDKKSNILQDEQRKL<br>SNINKKDLKKKVDQYIKDKDQEIKSKILCRIIFNSDFLKKYKKEIDNLIEDMESENE<br>NKFQEIYYPKERKNELYIYKKNLFLNIGNPNFDKIYGLISNDIKMADAKFLFNIDGK<br>NIRKNKISEIDAILKNLNDKLNGYSKEYKEKYIKKLKENDDFFAKNIQNKNYKSFE<br>KDYNRVSEYKKIRDLVEFNYLNKIESYLIDINWKLAIQMARFERDMHYIVNGLREL<br>GIIKLSGYNTGISRAYPKRNGSDGFYTTTAYYKFFDEESYKKFEKICYGFGIDLSENS<br>EINKPENESIRNYISHFYIVRNPPADYSIAEQIDRVSNLLSYSTRYNNSTYASVFEVF<br>KKDVNLDYDELKKKFKLIGNNDILERLMKPKKVSVLELESYNSDYIKNLIIELLTKI<br>ENTNDTL |

TABLE 4-continued

Cas13a

Cas13a orthologs

| c2c2-3 (SEQ ID NO: 64) | L wadei (Lw2) | MKVTKVDGISHKKYIEEGKLVKSTSEENRTSERLSELLSIRLDIYIKNPDNASEEENR IRRENLKKFFSNKVLHLKDSVLYLKNRKEKNAVQDKNYSEEDISEYDLKNKNSFS VLKKILLNEDVNSEELEIFRKDVEAKLNKINSLKYSFEENKANYQKINENNVEKVG GKSKRNITYDYYRESAKRNDYINNVQEAFDKLYKKEDIEKLFFLIENSKKHEKYKIR EYYHKIIGRKNDKENFAKIIYEEIQNVNNIKELIEKIPDMSELKKSQVFYKYYLDKE ELNDKNKIYAFCHFVEIEMSQLLKNYVYKRLSNISNDKIKRIFEYQNLKKLIENKLL NKLDTYVRNCGKYNYYLQVGEIATSDFIARNRQNEAFLRNIIGVSSVAYFSLRNILE TENENDITGRMRGKTVKNNGEEKYVSGEVDKIYNENKQNEVKENLKMFYSYDF NMDNKNEIEDFFANIDEATSSIRHGIVHFNLELEGKDIFAFKNIAPSEISKKMFQNEIN EKKLKLKIPFKQLNSANVFNYYEKDVIIKYLKNTKFNFVNKNIPFVPSFTKLYNKIED LRNTLKFFWSVPKDKEEKDAQIYLLKNIYYGEFLNKFVKNSKVFFKITNEVIKINKQ RNQKTGHYKYQKFENIEKTVPVEYLAIIQSREMINNQDKEEKNTYIDFIQQIFLKGFI DYLNKNNLKYIESNNNNDNNDIFSKIKIKKDNKEKYDKILKNYEKHNRNKEIPHEI NEFVREIKLGKILKYTENLNMFYLILKLLNHKELTNLKGSLEKYQSANKEETFSDEL ELINLLNLDNNRVTEDFELEANEIGKFLDFNENKIKDRKELKKFDTNKIYFDGENII KHRAFYNIKKYGMLNLLEKIADKAKYKISLKELKEYSNKKNEIEKNYTMQQNLHR KYARPKKDEKFNDEDYKEYEKAIGNIQKYTHLKNKVEFNELNLLQGLLLKILHRL VGYTSIWERDLRFRLKGEFPENHYIEEIFNEDNSKNVKYKSGQIVEKYINFYKELYK DNVEKRSIYSDKKVKKLKQEKKDLYIRNYIAHFNYIPHAEISLLEVLENLRKLLSYD RKLKNAIMKSIVDILKEYGFVATFKIGADKKIEIQTLESEKIVHLKNLKKKKLMTDR NSEELCELVKVMFEYKALEKRPAATKKAGQAKKKKKGSYPYDVPDYAYPYDVPD YAYPYDVPDYA* |
| c2c2-4 (SEQ ID NO: 65) | Listeria seeligeri | MWISIKTLIHHLGVLFFCDYMYNRREKKIIEVKTMRITKVEVDRKKVLISRDKNGG KLVYENEMQDNTEQIMHHKKSSFYKSVVNKTICRPEQKQMKKLVHGLLQENSQE KIKVSDVTKLNISNELNHRFKKSLYYFTENSPDKSEEYRIEINLSQLLEDSLKKQQGT FTCWESFSKDMELYINWAENYISSKTKLIKKSIRNNRIQSTESRSGQLMDRYMKDIL NKNKPFDIQSVSEKYQLEKLTSALKATFKEAKKNDKEINYKLKSTLQNHERQIIEEL KENSELNQFNIEIRKHLETYFPIKKTNRKVGDIRNLEIGEIQKIVNHRLKNKIVQRIL QEGKLASYEIESTVNSNSLQKIKIEEAFALKFINACLFASNNLRNMVYPVCKKDILM IGEFKNSFKEIKHKKFIRQWSQFFSQEITVDDIELASWGLRGAIAPIRNEIIHLKKHS WKKFFNNPTFKVKKSKIINGKTKDVTSEFLYKETLFKDYFYSELDSVPELIINKMES SKILDYYSSDQLNQVFTIPNFELSLLTSAVPFAPSFKRVYLKGFDYQNQDEAQPDY NLKLNIYNEKAFNSEAFQAYSLFKMVYYQVFLPQFTTNNDLFKSSVDFILTLNKE RKGYAKAFQDIRKMNKDEKPSEYMSYIQSQLMLYQKKQEEKEKINHFEKFINQVFI KGFNSFIEKNRLTYICHPTKNTVPENDNIEIPFHTDMDDSNIAFWLMCKLLDAKQLS ELRNEMIKFSCSLQSTEETSTFTKAREVIGLALLNGEKGCNDWKELFDDKEAWKKN MSLYVSEELLQSLPYTQEDGQTPVINRSIDLVKKYGTETILEKLFSSSDDYKVSAKD IAKLHEYDVTEKIAQQESLHKQWIEKPGLARDSAWTKKYQNVINDISNYQWAKTK VELTQVRHLHQLTIDLLSRLAGYMSIADRDFQFSSNYILERENSEYRVTSWILLSEN KNKNKYNDYELYNLKNASIKVSSKNDPQLKVDLKQLRLTLEYLELFDNRLKEKRN NISHFNYLNGQLGNSILELFDDARDVLSYDRKLKNAVSKSLKEILSSHGMEVTFKP LYQTNHHLKIDKLQPKKIHHLGEKSTVSSNQVSNEYCQLVRTLLTMK |
| C2-17 (SEQ ID NO: 66) | Leptotrichia buccalis C-1013-b | MKVTKVGGISHKKYTSEGRLVKSESEENRTDERLSALLNMRLDMYIKNPSSTETK ENQKRIGKLKKFFSNKMVYLKDNTLSLKNGKNIDREYSETDILESDVRDKKNF AVLKKIYLNENVNSEELEVFRNDIKKKLNKINSLKYSFEKNKANYQKINENNIEKV EGKSKRNIIYDYYRESAKRDAYVSNVKEAFDKLYKEEDIAKLVLEIENLTKLEKYK IREFYHEIIGRKNDKENFAKIIYEEIQNVNNMKELIEKVPDMSELKKSQVFYKYYLD KEELNDKNKIYAFCHFVEIEMSQLLKNYVYKRLSNISNDKIKRIFEYQNLKKLIENK LLNKLDTYVRNCGKYNYYLQDGEIATSDFIARNRQNEAFLRNIIGVSSVAYFSLRNI LETENENDITGRMRGKTVKNNGEEKYVSGEVDKIYNENKKNEVKENLKMFYSY DFNMDNKNEIEDFFANIDEAISSIRHGIVHFNLELEGKDIFAFKNIAPSEISKKMFQN EINEKKLKLKIFRQLNSANVFRYLEKYKILNYLKRTRFEFVNKNIPFVPSFTKLYSRI DDLKNSLGIYWKTPKTNDDNKTKEIIDAQIYLLKNIYYGEFLNYFMSNNGNFFEISK EIIIELNKNDKRNLKTGFYKLQKFEDIQKEKIPKEYLANIQSLYMINAGNQDEEEKDTY IDFIQKIFLKGFMTYLANNGRLSLIYIGSDEETNTSLAEKKQEFDKFLKKYEQNNNI KIPYEINEFLREIKLGNILKYTERLNMFYLILKLLNHKELTNLKGSLEKYQSANKEE AFSDQLELINLLNLDNNRVTEDFELEADEIGKFLDFNGNKVKINKELKKFDTNKIY FDGENIIKHRAFYNIKKYGMLNLLEKIADKAGYKISIEELKKYSNKKNEIEKNHKM QENLHRKYARPRKDEKFTDEDYESYKQAIENIEEYTHLKNKVEFNELNLLQGLLLR ILHRLVGYTSIWERDLRFRLKGEFPENQYIEEIFNFENKKNVKYKGGQIVEKYIKFY KELHQNDEVKINKYSSANIKVLKQEKKDLYIRNYIAHFNYIPHAEISLLEVLENLRK LLSYDRKLKNAVMKSVVDILKEYGFVATFKIGADKKIGIQTLESEKIVHLKNLKKK KLMTDRNSEELCKLVKIMFEYKMEEKKSEN |
| C2-18 (SEQ ID NO: 67) | Herbinix hemicellulo-silytica | MKLTRRRISGNSVDQKITAAFYRDMSQGLLYYDSEDNDCTDKVIESMDFERSWRG RILKNGEDDKNPFYMFVKGLVGSNDKIVCEPIDVSDPDNLDILINKNLTGFGRNL KAPDSNDTLENLIRKIQAGIPEEEVLPELKKIKEMIQKDIVNRKEQLLKSIKNNRIPFS LEGSKLVPSTKKMKWLFKLIDVPNKTFNEKMLEKYWEIYDYDKLKANITNRLDKT DKKARSISRAVSEELREYHKNLRTNYNRFVSGDRPAAGLDNGGSAKYNPDKEEFL LFLKEVEQYFKKYFPVKSKHSNKSKDKSLVDKYKNYCSYKVVKKEVNRSIINQLV AGLIQQGKLLYYFYYNDTWQEDFLNSYGLSYIQVEEAFKKSVMTSLSWGINRLTS FFIDDSNTVKFDDITTKKAKEAIESNYFNKLRTCSRMQDHFKEKLAFFYPVYVKDK KDRPDDDIENLIVLVKNAIESVSYLRNRTFHFKESSLLELLKELDDKNSGQNKIDYS VAAEFIKRDIENLYDVFREQIRSLGIAEYYKADMISDCFKTCGLEFALYSPKNSLMP |

TABLE 4-continued

| Cas13a | | |
|---|---|---|
| Cas13a orthologs | | |
| | | AFKNVYKRGANLNKAYIRDKGPKETGDQGQNSYKALEEYRELTWYIEVKNNDQS
YNAYKNLLQLIYYHAFLPEVRENEALITDFINRTKEWNRKETEERLNTKNNKKHK
NFDENDDITVNTYRYESIPDYQGESLDDYLKVLQRKQMARAKEVNEKEEGNNNYI
QFIRDVVVWAFGAYLENKLKNYKNELQPPLSKENIGLNDTLKELFPEEKVKSPFNI
KCRFSISTFIDNKGKSTDNTSAEAVKTDGKEDEKDKKNIKRKDLLCFYLFLRLLDE
NEICKLQHQFIKYRCSLKERRFPGNRTKLEKETELLAELEELMELVRFTMPSIPEISA
KAESGYDTMIKKYFKDFIEKKVFKNPKTSNLYYHSDSKTPVTRKYMALLMRSAPL
HLYKDIFKGYYLITKKECLEYIKLSNIIKDYQNSLNELHEQLERIKLKSEKQNGKDS
LYLDKKDFYKVKEYVENLEQVARYKHLQHKINFESLYRIFRIHVDIAARMVGYTQ
DWERDMHFLFKALVYNGVLEERRFEAIFNNNDDNNDGRIVKKIQNNLNNKNREL
VSMLCWNKKLNKNEFGAIIWKRNPIAHLNHFTQTEQNSKSSLESLINSLRILLAYDR
KRQNAVTKTINDLLLNDYHIRIKWEGRVDEGQIYENIKEKEDIENEPIIHLKHLHKK
DCYIYKNSYMFDKQKEWICNGIKEEVYDKSILKCIGNLFKFDYEDKNKSSANPKHT |
| C2-19
(SEQ ID
NO: 68) | [Eubacterium]
rectale | MLRRDKEVKKLYNVFNQIQVGTKPKKWNNDEKLSPEENERRAQQKNIKMKNYK
WREACSKYVESSQRIINDVIFYSYRKAKNKLRYMRKNEDILKKMQEAEKLSKFSG
GKLEDFVAYTLRKSLVVSKYDTQEFDSLAAMVVFLECIGKNNISDHEREIVCKLLE
LIRKDFSKLDPNVKGSQGANIVRSVRNQNMIVQPQGDRFLFPQVYAKENETVTNK
NVEKEGLNEFLLNYANLDDEKRAESLRKLRRILDVYFSAPNHYEKDMDITLSDNIE
KEKENVWEKHECGKKETGLEVDIPDVLMEAEAENIKLDAVVEKRERKVLNDRVR
KQNIICYRYTRAVVEKYNSNEPLFFENNAINQYWIHMENAVERILKNCKAGKLEK
LRKGYLAEKVWKDAINLISIKYIALGKAVYNFALDDIWKDKKNKELGIVDERIRNG
ITSFPDYEMIKAHENLQRELAVDIAFSVNNLARAVCDMSNLGNKESDFLLWKRNDI
ADKLKNKDDMASVSAVLQFFGGKSSWDINIFKDAYKGKKKYNYEVREDDLRKAI
YCARNENFHEKTALVNDEKWNTELFGKIFERETEFCLNVEKDREYSNNLYMFYQV
SELRNMLDHLYSRSVSRAAQVPSYNSVIVRTAFPEYITNVLGYQKPSYDADTLGK
WYSACYYLLKEIYYNSFLQSDRALQLFEKSVKTLSWDDKKQQRAVDNEKDHESDI
KSACTSLAQVCQIYMTEYNQQNNQIKKVRSSNDSIFDQPVYQHYKVLLKKAIANA
FADYLKNNKDLFGPIGKPPFKANEIREIDKEQFLPDWTSRKYEALCIEVSGSQELQK
WYIVGKELNARSLNLMVGSMRSYIQYVTDIKRRAASIGNELHVSVHDVEKVEKW
VQVIEVCSLLASRTSNQFEDYFNDKDDYARYLKSYVDFSNVDMPSEYSALVDFSN
EEQSDLYVDPKNPKVNRNIVHSKLFAADIELRDIVEPVSKDNIEEFYSQKAEIAYCK
IKGKEITAEEQKAVLKYQKLKNRVELRDIVEYGEIINELLGQLINWSFMREREDLLYF
QLGFHYDCLRNDSKKPEGYKNIKVDENSIKDAILYQIIGMYVNGVTVYAPEKDGD
KLKEQCVKGGVGVKVSAFHRYSKYLGLNEKTLYNAGLEIFEVVAEHEDIINLRNGI
DHFKYYLGDYRSMLSIYSEVEDREFTYDIKYQKNVLNLLQNILLRHNVIVEPILESG
FKTIGEQTKPGAKLSIRSIKSDTFQYKVKGGTLITDAKDERYLETIRKILYVAENEED
NLKKSVVVTNADKYEKNKESDDQNKQKEKKNKDNKGKKNEETKSDAEKNNNER
LSYNPFANLNFKLSN |
| C2-20
(SEQ ID
NO: 69) | Eubacteriaceae
bacterium
CHKCI004 | MKISKESHKRTAVAVMEDRVGGVVYVPGGSGIDLSNNLKKRSMDTKSLYNVFNQ
IQAGTAPSEYEWKDYLSEAENKKREAQKMIQKANYELRRECEDYAKKANLAVSRI
IFSKKPKKIFSDDDIISHMKKQRLSKFKGRMEDEVLIALRKSLVVSTYNQEVEDSRK
AATVFLKNIGKKNISADDERQIKQLMALIREDYDKWNPDKDSSDKKESSGTKVIRS
IEHQNMVIQPEKNKLSLSKISNVGKKTKTKQKEKAGLDAFLKEYAQIDENSRMEY
LKKLRRLLDTYFAAPSSYIKGAAVSLPENINFSSELNVWERHEAAKKVNINFVEIPE
SLLNAEQNNNKINKVEQEHSLEQLRTDIRRRNITCYHFANALAADERYHTLFFENM
AMNQFWIEIHMENAVERILKKCNVGTLFKLRIGYLSEKVWKDMLNLLSIKYIALGK
AVYHFALDDIWKADIWKDASDKNSGKINDLTLKGISSFDYEMVKAQEDLQREMA
VGVAFSTNNLARVTCKMDDLSDAESDELLWNKEAIRRHVKYTEKGEILSAILQFFG
GRSLWDESLFEKAYSDSNYELKFLDDLKRAIYAARNETFHFKTAAIDGGSWNTRL
FGSLFEKEAGLCLNVEKNKFYSNNLVLFYKQEDLRVFLDKLYGKECSRAAQIPSY
NTILPRKSFSDFMKQLLGLKEPVYGSAILDQWYSACYYLEKEVYYNLFLQDSSAK
ALFEKAVKALKGADKKQEKAVESFRKRYWEISKNASLAEICQSYITEYNQQNNKE
RKVRSANDGMFNEPIYQHYKMLLKEALKMAFASYIKNDKELKEVYKPTEKLFEVS
QDNFLPNWNSEKYNTLISEVKNSPDLQKWYIVGKFMNARMLNLLLGSMRSYLQY
VSDIQKRAAGLGENQLHLSAENVGQVKKWIQVLEVCLLLSVRISDKFTDYFKDEE
EYASYLKEYVDFEDSAMPSDYSALLAFSNEGKIDLYVDASNPKVNRNIIQAKLYAP
DMVLKKVVKKISQDECKEFNEKKEQIMQFKNKGDEVSWEEQQKILEYQKLKNRV
ELRDLSEYGELINELLGQLINWSYLRERDLLYFQLGFHYSCLMNESKKPDAYKTIft
RGTVSIENAVLYQIIAMYINGFPVYAPEKGELKPQCKTGSAGQKIRAFCQWASMVE
KKKYELYNAGLELFEVVKEHDNIIDLRNKIDHFKYYQGNDSILALYGEIFDRFFTY
DMKYRNNVLNHLQNILLRHNVIIKPIISKDKKEVGRGKMKDRAAELLEEVSSDRFT
YKVKEGERKIDAKNRLYLETVRDILYFPNRAVNDKGEDVIICSKKAQDLNEKKAD
RDKNHDKSKDTNQKKEGKNQEEKSENKEPYSDRMTWKPFAGIKLE |
| C2-21
(SEQ ID
NO: 70) | Blautia sp.
Marseille-
P2398 | MKISKVDHVKSGIDQKLSSQRGMLYKQPQKKYEGKQLEEHVRNLSRKAKALYQV
FPVSGNSKMEKELQIINSFIKNILLRLDSGKTSEEIVGYINTYSVASQISGDHIQELVD
QHLKESLRKYTCVGDKRIYVPDIIVALLKSKENSETLQYDNSELKILIDFIREDYLKE
KQIKQIVHSIENNSTPLRIAEINGQKRLIPANVDNPKKSYIFEFLKEYAQSDPKGQES
LLQHMRYLILLYLYGPDKITDDYCEEIEAWNFGSIVMDNEQLFSEEASMLIQDRIY
VNQQIEEGRQSKDTAKVKKNKSKYRMLGDKIEHSINESVVKHYQEACKAVEEKDI
PWIKYISDHVMSVYSSKNRVDLDKLSLPYLAKNTWNTWISFIAMKYVDMGKGVY
HFAMSDVDKVGKQDNLIIGQIDPKFSDGISSEDYERIKAEDDLHRSMSGYIAFAVN
NFARAICSDEFRKKNRKEDVLTVGLDEIPLYDNVKRLLQYFGGASNWDDSIIDIID
DKDLVACIKENLYVARNVNEHFAGSEVQKKQDDILEEIVRKETRDIGKHYRKVF |

TABLE 4-continued

Cas13a

Cas13a orthologs

|  |  |  |
|---|---|---|
|  |  | YSNNVAVEYCDEDIIKLMNHLYQREKPYQAQIPSYNKVISKTYLPDLIFMLLKGKN<br>RTKISDPSIMNMFRGTFYFLLKEIYYNDFLQASNLKEMFCEGLKNNVKNKKSEKPY<br>QNFMRRFEELENMGMDFGEICQQIMTDYEQQNKQKKKTATAVMSEKDKKIRTLD<br>NDTQKYKHERTLLYIGLREAFITYLKDEKNKEWYEFLREPVKREQPEEKEFVNKW<br>KLNQYSDCSELILKDSLAAAWYVVAHFINQAQLNHLIGDIKNYIQFISDIDRRAKST<br>GNPVSESTEIQIERYRKILRVLEFAKFFCGQITNVLTDYYQDENDFSTHVGHYVKFE<br>KKNMEPAHALQAFSNSLYACGKEKKKAGFYYDGMNPIVNRNITLASMYGNKKLL<br>ENAMNPVTEQDIRKYYSLMAELDSVLKNGAVCKSEDEQKNLRHFQNLKNRIELV<br>DVLTLSELVNDLVAQLIGWVYIRERDMMYLQLGLHYIKLYFTDSVAEDSYLRTLD<br>LEEGSIADGAVLYQIASLYSFNLPMYVKPNKSSVYCKKHVNSVATKFDIFEKEYCN<br>GDETVIENGLRLFENINLHKDMVKFRDYLAHFKYFAKLDESILELYSKAYDFFFSY<br>NIKLKKSVSYVLTNVLLSYFINAKLSFSTYKSSGNKTVQHRTTKISVVAQTDYFTY<br>KLRSIVKNKNGVESIENDDRRCEVVNIAARDKEFVDEVCNVINYNSDK |
| C2-22<br>(SEQ ID<br>NO: 71) | Leptotrichia sp.<br>oral taxon 879<br>str. F0557 | MGNLFGHKRWYEVRDICGDFKIKRKVKVKRNYDGNKYILNINENNNKEKIDNNKF<br>IGEFVNYKKNNNVLKEFKRKFHAGNILFKLKGKEEIIRIENNDDFLETEEVVLYIEV<br>YGKSEKLKALEITKKKIIDEAIRQGITKDDKKIEEKRQENEEEIEIDIRDEYTNKTLND<br>CSIILRIIENDELETKKSIYEIFKNINMSLYKIIEKIIENETEKVFENRYYEEHLREKLLK<br>DNKIDVILTNEMEIREKIKSNLEIMGFVKFYLNVSGDKKKSENKKMFVEKILNTNV<br>DLTVEDIVDFIVKELKFWNITKRIEKVKKFNNEFLENRRNRTYIKSYVLLDKHEKFK<br>IERENKKDKIVKFFVENIKNNSIKEKIEKILAEFKINELIKKLEKELKKGNCDTEIFGIF<br>KKHYKVNFDSKKFSNKSDEEKELYKIIYRYLKGRIEKILVNEQKVRLKKMEKIEIEK<br>ILNESILSEKILKRVKQYTLEHIMYLGKLRHNDIVKMTVNTDDFSRLHAKEELDLEL<br>ITFFASTNMELNKIFNGKEKVTDFFGFNLNGQKITLKEKVPSFKLNILKKLNFINNE<br>NNIDEKLSHFYSFQKEGYLLRNKILHNSYGNIQETKNLKGEYENVEKIIKELKVSD<br>EEISKSLSLDVIFEGKVDIINKINSLKIGEYKDKKYLPSFSKIVLEITRKFREINKDKLF<br>DIESEKIILNAVKYVNKILYEKITSNEENEFLKTLPDKLVKKSNNKKENKNLLSIEEY<br>YKNAQVSSSKGDKKAIKKYQNKVTNAYLEYLENTFTEIIDFSKFNLNYDEIKTKIEE<br>RIGDNKSKIIIDSISTNINITNDIEVIISIFALLNSNTYINKIRNRFFATSVWLEKQNGTK<br>EYDYENIISILDEVLLINLLRENNITDILDLKNAIIDAKIVENDETYIKNYIFESNEEKL<br>KKRLFCEELVDKEDIRKIFEDENPKFKSFIKKNEIGNFKINFGILSNLECNSEVEAKKI<br>IGKNSKKLESFIQNIIDEYKSNIRTLFSSEFLEKYKEEIDNLVEDTESENKNKFEKIYY<br>PKEHKNELYIYKKNLFLNIGNPNFDKIYGLISKDIKNVDTKILFDDDIKKNKISEIDAI<br>LKNLNDKLNGYSNDYKAKYVNKLKENDDFFAKNIQNENYSSFGEFEKDYNKVSE<br>YKKIRDLVEFNYLNKIESYLIDINWKLAIQMARFERDMHYIVNGLRELGIIKLSGYN<br>TGISRAYPKRNGSDGFYTTTAYYKFFDEESYKKFEKICYGFGIDLSENSEINKPENES<br>IRNYISHFYIVRNPFADYSIAEQIDRVSNLLSYSTRYNNSTYASVFEVFKKDVNLDY<br>DELKKKFRLIGNNDILERLMKPKKVSVLELESYNSDYIKNLIIELLTKIENTNDTL |
| C2-23<br>(SEQ ID<br>NO: 72) | Lachnospiraceae<br>bacterium<br>NK4A144 | MKISKVDHTRMAVAKGNQHRRDEISGILYKDPTKTGSIDFDERFKKLNCSAKILYH<br>VFNGIAEGSNKYKNIVDKVNNNLDRVLFTGKSYDRKSIIDIDTVLRNVEKINAFDRI<br>STEEREQIIDDLLEIQLRKGLRKGKAGLREVLLIGAGVIGKPKQEIADFLEILDED<br>FNKTNQAKNIKLSIENQGLVVSPVSRGEERIFDVSGAQKGKSSKKAQEKEALSAFL<br>LDVADLDKNVRFEYLRKIRRLINLYFYVKNDDVMSLTEIPAEVNLEKDFDIWRDH<br>EQRKEENGDFVGCPDILLADRDVKKSNSKQVKIAERQLRESIREKNIKRYRFSIKTI<br>EKDDGTYFFANKQISVFWIFIRIENAVERILSGINDKKLYRLRLGYLGEKVWKDILN<br>FLSIKYIAVGKAVFNFAMDDLQEKDRDIEPGKISENAVNGLTSFDYEQIKADEMLQ<br>REVAVNVAFAANNLARVTVDIPQNGEKEDILLWNKSDIKKYKKNSKKGILKSILQF<br>FGGASTWNMKMFEIAYHDQPGDYEENYLYDIIQIIYSLRNKSFHFKTYDHGDKNW<br>NRELIGKMIEHDAERVISVEREKFHSNNLPMFYKDADLKKILDLLYSDYAGRASQV<br>PAFNTVLVRKNEPEFLRIGDMGYKVHFNNPEVENQWHSAVYYLYKEIYYNLFLRD<br>KEVKNLFYTSLKNIRSEVSDKKQKLASDDFASRCEEIEDRSLPEICQIIMTEYNAQN<br>FGNRKVKSQRVIEKNKDIFRHYKMLLIKTLAGAFSLYLKQERFAFIGKATPIPYETT<br>DVKNFLPEWKSGMYASFVEEIKNNLDLQEWYIVGRFLNGRMLNQLAGSLRSYIQY<br>AEDIIERRAAENRNKLFSKPDEKIEACKKAVRVLDLCIKISTRISAEFTDYFDSEDDY<br>ADYLEKYLKYQDDAIKELSGSSYAALDHFCNKDDLKFDIYVNAGQKPILQRNIVM<br>AKLFGPDNILSEVMEKVTESAIREYYDYLKKVSGYRVRGKCSTEKEQEDLLKFQR<br>LKNAVEFRDVTEYAEVINELLGQLISWSYLRERDLLYFQLGFHYMCLKNKSFKPA<br>EYVDIRRNNGTIIHNAILYQIVSMYINGLDFYSCDKEGKTLKPIETGKGVGSKIGQFI<br>KYSQYLYNDPSYKLEIYNAGLEVFENIDEHDNITDLRKYVDHFKYVAYGNKMSLL<br>DLYSEFFDRFFTYDMKYQKNVVNVLENILLRHFVIFYPKGGSGKKDVGIRDCKKER<br>AQIEISEQSLTSEDFMFKLDDKAGEEAKKFPARDERYLQTIAKLLYYPNEIEDMNRF<br>MKKGETINKKVQFNRKKKITRKQKNNSSNEVLSSTMGYLFKNIKL |
| C2-24<br>(SEQ ID<br>NO: 73) | Chloroflexus<br>aggregans | MTDQVRREEVAAGELADTPLAAAQTPAADAAVAATPAPAEAVAPTPEQAVDQPA<br>TTGESEAPVTTAQAAAHEAEPAEATGASETPVSEQQPQKPRRLKDLQPGMELEGK<br>VTSIALYGIFVDVGVGRDGLVHISEMSDRRIDTPSELVQIGDTVKVWKVSVDLDAR<br>RISLTMLNPSRGEKPRRSRQSQPAQPQPRRQEVDREKLASLKVGEIVEGVITGFAPF<br>GAFADIGVGKDGLIHISELSEGRVEKPEDAVKVGERYQFKVLEIDGEGTRISLSRR<br>AQRTQRMQQLEPGQIIEGTVSGIATFGAFVDIGVGRDGLVHISALAPHRVAKVEDV<br>VKVGDKVKVKVLGVDPQSKRISLTMRLEEEQPATTAGDEAAEPAEEVTPTRRGNL<br>ERFAAAAQTARERSERGERSERGERRERRERRPAQSSPDTYIVGEDDDESFEGNATI<br>EDLLTKFGGSSSRRDRDRRRRHEDDDDEEMERPSNRRQREAIRRTLQQIGYDE |
| C2-25<br>(SEQ ID | Demequina<br>aurantiaca | MDLTWHALLILFIVALLAGFLDTLAGGGGLLTVPALLLTGIPPLQALGTNKLQSSF<br>GTGMATYQVIRKKRVHWRDVRWPMVWAFLGSAAGAVAVQFIDTDALLIIIPVVL |

TABLE 4-continued

Cas13a

Cas13a orthologs

| | | |
|---|---|---|
| NO: 74) | | ALVAAYFLEVPKSHLPPPEPRMSDPAYEATLVPIIGAYDGAFGPGTGSLYALSGVA<br>LRAKTLVQSTAIAKTLNFATNFAALLVFAFAGHMLWTVGAVMIAGQLIGAYAGS<br>HMLFRVNPLVLRVLIVVMSLGMLIRVLLD |
| C2-26<br>(SEQ ID<br>NO: 75) | Thalassospira<br>sp. TSL5-1 | MRIIKPYGRSHVEGVATQEPRRKLRLNSSPDISRDIPGFAQSHDALIIAQWISAIDKIA<br>TKPKPDKKPTQAQINLRTTLGDAAWQHVMAENLLPAATDPAIREKLHLIWQSKIA<br>PWGTARPQAEKDGKPTPKGGWYERFCGVLSPEAITQNVARQIAKDIYDHLHVAA<br>KRKGREPAKQGESSNKPGKFKPDRKRGLIEERAESIAKNALRPGSHAPCPWGPDD<br>QATYEQAGDVAGQIYAAARDCLEEKKRRSGNRNTSSVQYLPRDLAAKILYAQYG<br>RVFGPDTTIKAALDEQPSLFALHKAIKDCYHRLINDARKRDILRILPRNMAALFRLV<br>RAQYDNRDINALIRLGKVIBYHASEQGKSEHHGIRDYWPSQQDIQNSRFWGSDGQ<br>ADIKRHEAFSRIWRHIIALASRTLHDWADPHSQKFSGENDDILLLAKDAIEDDVFK<br>AGHYERKCDVLFGAQASLFCGAEDFEKAILKQAITGTGNLRNATFHFKGKVRFEK<br>ELQELTKDVPVEVQSAIAALWQKDAEGRTRQIAETLQAVLAGHFLTEEQNRHITA<br>ALTAAMAQPGDVPLPRLRRVLARHDSICQRGRILPLSPCPDRAKLEESPALTCQYT<br>VLKMLYDGPFRAWLAQQNSTILNHYIDSTIARTDKAARDMNGRKLAQAEKDLITS<br>RAADLPRLSVDEKMGDFLARLTAATATEMRVQRGYQSDGENAQKQAAFIGQFEC<br>DVIGRAFADFLNQSGEDEVLKLKADTPQPDAAQCDVTALIAPDDISVSPPQAWQQ<br>VLYFILHLVPVDDASHLLHQIRKWQVLEGKEKPAQIAHDVQSVLMLYLDMHDAK<br>FTGGAALHGIEKPAEFFAHAADFRAVFPPQSLQDQDRSIPRRGLREIVRFGHLPLLQ<br>HMSGTVQITHDNVVAWQAARTAGATGMSPIARRQKQREELHALAVERTARERNA<br>DLQNYMBALVDVIKHRQLSAQVTLSDQVRLHRLMMGVLGRLVDYAGLWERDLY<br>FVVLALLYHHGATPDDVFKGQGKKNLADGQVVAALKPKNRKAAAPVGVFDDLD<br>HYGIYQDDRQSIRNGLSHFNMLRGGKAPDLSHWVNQTRSLVAHDRKLKNAVAKS<br>VIEMLAREGFDLDWGIQTDRGQHILSHGKIRTRQAQHFQKSRLHIVKKSAKPDKN<br>DTVKIRENLHGDAMVERVVQLFAAQVQKRYDITVEKRLDHLFLKPQDQKGKNGI<br>HTHNGWSKTEKKRRPSRENRKGNHEN |
| C2-27<br>(SEQ ID<br>NO: 76) | SAMN04487830_<br>13920<br>[Pseudo-<br>butyrivibrio<br>sp. OR37] | MKESKESHRKTAVGVTESNGIIGLLYKDPLNEKEKIEDVVNQRANSTKRLFNLEGT<br>EATSKDISRASKDLAKVVNKAIGNLKGNKKENKKEQITKGLNTKIIVEELKNVLKD<br>EKKLIVNKDIIDEACSRLLKTSFRTAKTKQAVKMILTAVLIENTNLSKEDEAFVHEY<br>FVKKLVNEYNKTSVKKQIPVALSNQNMVIQPNSVNGTLEISETKKSKETKTTEKDA<br>FRAFLRDYATLDENRRHKMRLCLRNLVNLYFYGETSVSKDDFDEWRDHEDKKQN<br>DELFVKKIVSIKTDRKGNVKEVLDVDATIDAIRTNNIACYRRALAYANENPDVFFS<br>DTMLNKFWIEHVENEVERIYGHINNNTGDYKYQLGYLSEKVWKGIINYLSIKYIAE<br>GKAVYNYAMNALAKDNNSNAFGKLDEKEVGITSFEYERIKAEETLQRECAVNIA<br>FAANHLANATVDLNEKDSDFLLLKHEDNKDTLGAVARPNILRNILQFFGGKSRWN<br>DFDFSGIDEIQLLDDLRKWYSLRNSSFHFKTENIDNDSWNTKLIGDMFAYDFNMA<br>GNVQKDKMYSNNVPMFYSTSDIEKMLDRLYAEVHERASQVPSENSVEVRKNFPD<br>YLKNDLKITSAFGVDDALKWQSAVYYVCKEIYYNDFLQNPETFTMLKDYVQCLPI<br>DIDKSMDQKLKSERNAHKNFKEAFATYCKECDSLSAICQMEVITEYNNQNKGNRK<br>VISARTKDGDKLIYKHYKMILFEALKNVETIYLEKNINTYGELKKPKLINNVPAIEEF<br>LPNYNGRQYETLVNRITEETELQKWYIVGRLLNPKQVNQLIGNFRSYVQYVNDVA<br>RRAKQTGNNLSNDNIAWDVKNIIQIFDVCTKLNGVTSNILEDYFDDGDDYARYLK<br>NFVDYTNKNNDHSATLLGDFCAKEIDGIKIGIYHDGTNPIVNRNIIQCKLYGATGIIS<br>DLTKDGSILSVDYEIIKKYMQMQKEIKVYQQKGICKTKEEQQNLKKYQELKNIVEL<br>RNIIDYSEILDELQGQLINWGYLRERDLMYFQLGEHYLCLHNESKKPVGYNNAGDI<br>SGAVLYQIVAMYTNGLSLIDANGKSKKNAKASAGAKVGSFCSYSKEIRGVDKDTK<br>EDDDPIYLAGVELFENINEHQQCINLRNYIEHEHYYAKHDRSMLDLYSEVEDREFT<br>YDMKYTKNVPNMMYNILLQHLVVPAFEFGSSEKRLDDNDEQTKPRAMFTLREKN<br>GLSSEQFTYRLGDGNSTVKLSARGDDYLRAVASLLYYPDRAPEGLIRDAEAEDKE<br>AKINHSNPKSDNRNNRGNFKNPKVQTKRK |
| C2-28<br>(SEQ ID<br>NO: 77) | SAMN02910398_<br>00008<br>[Butyrivibrio<br>sp. YAB3001] | MKISKVDHRKTAVKITDNKGAEGFIYQDPTRDSSTMEQIISNRARSSKVLENIFGDT<br>KKSKDLNKYTESLIIYVNKAIKSLKGDKRNNKYEEITESLKTERVLNALIQAGNEFT<br>CSENNIEDALNKYLKKSERVGNTKSALKKLLMAAYCGYKLSIEEKEEIQNYFVDK<br>LVKEYNKDTVLKYTAKSLKHQNMVVQPDTDNHVFLPSRIAGATQNKMSEKEALT<br>EFLKAYAVLDEEKRHNLRIILRKLVNLYFYESPDFIYPENNEWKEHDDRKNKTETF<br>VSPVKVNEEKNGKTFVKIDVPATKDIIRLKNIECYRRSVAETAGNPITYFTDHNISK<br>FWIHMENEVEKIFALLKSNWIGDYQFSVGYISEKVWKEIINYLSIKYIAIGKAVYNY<br>ALEDIKKNDGTLNEGVIDPSFYDGINSFEYEKIKAEETFQREVAVYVSFAVNHLSSA<br>TVKLSEAQSDMLVLNKNDIEKIAYGNTKRNILQFFGGQSKWKEFDFDRYINPVNY<br>TDIDELFDIKKMVYSLRNESFEETTTDTESDWNKNLISAMFEYECRRISTVQKNKFF<br>SNNLPLFYGENSLERVLHKLYDDYVDRMSQVPSFGNVEVRKKEPDYMKEIGIKHN<br>LSSEDNLKLQGALYFLYKEIYYNAFISSEKAMKIFVDLVNKLDTNARDDKGRITHE<br>AMAHKNFKDAISHYMTHDCSLADICQKIMTEYNQQNTGHRKKQTTYSSEKNPEIF<br>RHYKMILFMLLQKAMTEYISSEEIFDFIMKPNSPKTDIKEEEFLPQYKSCAYDNLIK<br>LIADNVELQKWYITARLLSPREVNQLIGSFRSYKQFVSDIERRAKETNNSLSKSGMT<br>VDDVENITKVLDLCTKLNGRFSNELTDYFDSKDDYAVYVSKFLDEGFKIDEKEPAAL<br>LGEFCNKEENGKKIGIYHNGTEPILNSNIIKSKLYGITDVVSRAVKPVSEKLIREYLQ<br>QEVKIKPYLENGVCKNKEEQAALRKYQLKNRIEFRDIVEYSEIINELMGQLINFSY<br>LRERDLMYFQLGFHYLCLNNYGAKPEGYYSIVNDKRTIKGAILYQIVAMYTGLPI<br>YHYVDGTISDRRKNKKTVLDTLNSSETVGAKIKYFIYYSDELFNDSLILYNAGLELF<br>ENINEHENIVNLRKYIDHFKYYVSQDRSLLDIYSEVFDRYFTYDRKYKKNVMNLFS<br>NIMLKHFIITDFEFSTGEKTIGEKNTAKKECAKVRIKRGGLSSDKFTYKFKDAKPIEL<br>SAKNTEFLDGVARILYYPENVVLTDLVRNSEVEDEKRIEKYDRNHNSSPTRKDKTY |

TABLE 4-continued

Cas13a

Cas13a orthologs

| | | |
|---|---|---|
| | | KQDVKKNYNKKTSKAFDSSKLDTKSVGNNLSDNPVLKQFLSESKKKR |
| C2-29 (SEQ ID NO: 78) | *Blautia* sp. Marseille-P2398 | MKISKVDHVKSGIDQKLSSQRGMLYKQPQKKYEGKQLEEHVRNLSRKAKALYQV FPVSGNSKMEKELQIINSFIKNILLRLDSGKTSEEIVGYINTYSVASQISGDHIQELVD QHLKESLRKYTCVGDKRIYVPDIIVALLKSKENSETLQYDNSELKILIDFIREDYLKE KQIKQIVHSIENNSTPLRIAEINGQKRLIPANVDNPKKSYIFEFLKEYAQSDPKGQES LLQHMRYLILLYLGPDKITDDYCEEIEAWNFGSIVMDNEQLFSEEASMLIQDRIY VNQQIEEGRQSKDTAKVKKNKSKYRMLGDKIEHSINESVVKHYQEACKAVEEKDI PWIKYISDHVMSVYSSKNRVDLDKLSLPYLAKNTWNTWISFIAMKYVDMGKGVY HFAMSDVDKVGKQDNLIIGQIDPKFSDGISSEDYERIKAEDDLHRSMSGYIAFAVN NFARAICSDEFRKKNRKEDVLTVGLDEIPLYDNVKRKLLQYFGGASNWDDSIIDIID DKDLVACIKENLYVARNVNEHFAGSEKVQKKQDDILEEIVRKETRDIGKHYRKVF YSNNVAVEYCDEDIIKLMNHLYQREKPYQAQIPSYNKVISKTYLPDLIFMLLKGKN RTKISDPSIMMNMFRGTFYFLLKEIYYNDFLQASNLKEMFCEGLKNNVKNKKSEKPY QNFMRRFEELENMGMDFGEICQQIMTDYEQQNKQKKKTATAVMSEKDKKIRTLD NDTQKYKHERTLLYIGLREAFITYLKDEKNKEWYEFLREPVKREQPEEKEFVNKW KLNQYSDCSELILKDSLAAAWYVVAHFINQAQLNHLIGDIKNYIQFISDIDRRAKST GNPVSESTEIQIERYRKIIRVLEFAKFFCGQITNVLTDYYQDENDFSTHVGHYVKFE KKNMEPAHALQAFSNSLYACGKEKKKAGFYYDGMNPIVNRNITLASMYGNKKLL ENAMNPVTEQDIRKYYSLMAELDSVLKNGAVCKSEDEQKNLRHFQNLKNRIELV DVLTLSELVNDLVAQLIGWVYIRERDMMYLQLGLHYIKLYFTDSVAEDSYLRTLD LEEGSIADGAVLYQIASLYSFNLPMYVKPNKSSVYCKKHVNSVATKEDIFEKEYCN GDETVIENGLRLFENINLHKDMVKFRDYLAHPKYFAKLDESILELYSKAYDFFFSY NIKLKKSVSYVLTNVLLSYFINAKLSFSTYKSSGNKTVQHRTTKISVVAQTDYFTY KLRSIVKNKNGVESIENDDRRCEVVNIAARDKEFVDEVCNVINYNSDK |
| C2-30 (SEQ ID NO: 79) | *Leptotrichia* sp. Marseille-P3007 | MKITKIDGISHKKYIKEGKLVKSTSEENKTDERLSELLTIRLDTYIKNPDNASEEENR IRRENLKEFFSNKVLYLKDGILYLKDRREKNQLQNKNYSEEDISEYDLKNKNNFLV LKKILLNEDINSEELEIFRNDFEKKLDKINSLKYSLEENKANYQKINENNIKKVEGK SKRNIFYNYYKDSAKRNDYINNIQEAFDKLYKKEDIENLFELIENSKKHEKYKIREC YHKIIGRKNDKENFATIIYEEIQNVNNMKELIEKVPNVSELKKSQVFYKYYLNKEK LNDENIKYVFCHFVEIEMSKLLKNYVYKKPSNISNDKVKRIFEYQSLKKLIENKLLN KLDTYVRNCGKYSFYLQDGEIATSDFIVGNRQNEAFLRNIIGVSSTAYFSLRNILET ENENDITGRMRGKTVKNNKGEEKYISGEIDKLYDNNKQNEVKKNLKMFYSYDFN MNSKKEIEDFFSNIDEAISSIRHGIVHFNLELEGKDIFTFKNIVPSQISKKMIEDEINE KKLKLKIFKQLNSANVERYLEKYKILNYLNRTRFEFVNKNIPVPVPSETKLYSRIDDL KNSLGIYWKTPKTNDDNKTKEITDAQIYLLKNIYYGEFLNYEMSNNGNEFEITKEII ELNKNDKRNLKTGFYKLQKFENLQEKTPKEYLANIQSLYMINAGNQDEEEKDTYI DFIQKIFLKGFMTYLANNGRLSLIYIGSDEETNTSLAEKKQEFDKFLKKYEQNNNIEI PYEINEFVREIKLGKIKLKYTERLNMFYLILKLLNHKELTNLKGSLEKYQSANKEEAF SDQLELINLLNLDNNRVTEDFELEADEIGKELDENGNKVKDNKELKKEDTNKIYED GENIIKHRAFYNIKKYGMLNLLEKISDEAKYKISIEELKNYSKKKNEIEENHTTQEN LHRKYARPRKDEKFTDEDYKKYEKAIRNIQQYTHLKNKVEFNELNLLQSLLLRILH RLVGYTSIVVERDLRFRLKGEFPENQYIEEIFNEDNSKNVKYKNGQIVEKYINFYKEL YKDDTEKISIYSDKKVKELKKEKKDLYIRNYIAHENYIPNAEISLLEMLENLRKLLS YDRKLKNAIMKSIVDILKEYGFVVTFKIEKDKKIRIESLKSEEVVHLKKLKLKDND KKKEPIKTYRNSKELCKLVKVMFEYKMKEKKSEN |
| C2-31 (SEQ ID NO: 80) | *Bacteroides ihuae* | MRITKVKVKESSDQKDKMVLIHRKVGEGTLVLDENLADLTAPIIDKYKDKSFELSL LKQTLVSEKEMNIPKCDKCTAKERCLSCKQREKRLKEVRGAIEKTIGAVIAGRDIIP RLNIFNEDEICWLIKPKLRNEFTEKDVNKQVVKLNLPKVLVEYSKKNDPTLFLAYQ QWIAAYLKNKKGHIKKSILNNRVVIDYSDESKLSKRKQALELWGEEYETNQRIALE SYHTSYNIGELVTLLPNPEEYVSDKGEIRPAFHYKLKNVLQMHQSTVEGTNEILCIN PIFNENRANIQLSAYNLEVVKYFEHYFPIKKKKKNLSLNQAIYYLKVETLKERLSLQ LENALRMNLLQKGKIKKHEFDKNTCSNTLSQIKRDEFFVLNLVEMCAFAANNIRNI VDKEQVNEILSKKDLCNSLSKNTIDKELCTKEYGADFSQIPVAIWAMRGSVQQIRN EIVHYKAEAIDKIFALKTFEYDDMEKDYSDTPFKQYLELSIEKIDSFFIEQLSSNDVL NYYCTEDVNKLLNKCKLSLRRTSIPFAPGFKTIYELGCHLQDSSNTYRIGHYLMLIG GRVANSTVTKASKAYPAYRFMLKLIYNHLFLNKFLDNHNKRFFMKAVAFVLKDN RENARNKFQYAFKEIRMMNNDESIASYMSYIHSLSVQEQEKKGKNDKVRYNTE KFIEKVEVKGFDDPLSWLGVEFILSPNQEERDKTVTREEYENLMIKDRVEHSINSNQ ESHIAFFTECKLLDANHLSDLRNEWIKERSSGDKEGESYNFAIDIIELCLLTVDRVEQ RRDGYKEQTELKEYLSFFIKGNESENTVWKGFYFQQDNYTPVLYSPIELIRKYGTL ELLKLIIVDEDKITQGEFEEWQTLKKVVEDKVTRRNELHQEWEDMKNKSSFSQEK CSIYQKLCRDIDRYNWLDNKLHLVHLRKLHNLVIQILSRMARFIALWDRDEVLLD ASRANDDYKLLSFFNERDFINAKKTKTDDELLAEFGSKIEKKNAPFIKAEDVPLMV ECIEAKRSFYQKVFERNNLQVLADRNFIAHYNYISKTAKCSLFEMIIKLRTLMYYD RKLRNAVVKSIANVEDQNGMVLQLSLDDSHELKVDKVISKRIVHLKNNNIMTDQV PEEYYKICRRLLEMKK |
| C2-32 (SEQ ID NO: 81) | SAMN05216357_ 1045 [*Porphyromona daceae bacterium* KH3 CP3RA] | MEFRDSIFKSLLQKEIEKAPLCFAEKLISGGVFSYYPSERLKEFVGNHPFSLFRKTMP FSPGFKRVMKSGGNYQNANRDGREYDLDIGVYLPKDGEGDEEWNARYFLMKLIY NQLFLPYFADAENHLFRECVDEVKRVNRDYNCKNNNSEEQAFIDIRSMREDESIAD YLAFIQSNIIIEENKKKETNKEGQINFNKFLLQVFVKGFDSFLKDRTELNFLQLPELQ GDGTGRDDLESLDKLGAVVAVDLKLDATGIDADLNENISFYTECKLLDSNHLSRL RNEIIKYQSANSDFSHNEDFYDRIISIIELCMLSADHVSTNDNESIFPNNDKDFSGIR |

TABLE 4-continued

Cas13a

Cas13a orthologs

| | | |
|---|---|---|
| | | PYLSTDAKVETFEDLYVHSDAKTPITNATMVLNWKYGTDKLFERLMISDQDFLVT<br>EKDYFVWKELKKDIEEKIKLREELHSLWVNTPKGKKGAKKKNGRETTGEFSEENK<br>KEYLEVCREIDRYVNLDNKLHFVHLKRMHSLLIELLGREVGFTYLFERDYQYYHL<br>EIRSRRNKDAGVVDKLEYNKIKDQNKYDKDDFFACTFLYEKANKVRNFIAHENYL<br>TMWNSPQEEEHNSNLSGAKNSSGRQNLKCSLTELINELREVMSYDRKLKNAVTKA<br>VIDLEDKHGMVIKFRIVNNNNNDNKNKHHLELDDIVPKKIMHLRGIKLKRQDGKPI<br>PIQTDSVDPLYCRMWKKLLDLKPTPF |
| C2-33<br>(SEQ ID<br>NO: 82) | *Listeria<br>riparia* | MHDAWAENPKKPQSDAFLKEYKACCEAIDTYNWHKNKATLVYVNELHHLLIDIL<br>GRLVGYVAIADRDFQCMANQYLKSSGHTERVDSWINTIRKNRPDYIEKLDIFMNK<br>AGLEVSEKNGRNYIAHLNYLSPKHKYSLLYLFEKLREMLKYDRKLKNAVTKSLID<br>LLDKHGMCVVFANLKNNKHRLVIASLKPKKIETFKWKKIK |
| C2-34<br>(SEQ ID<br>NO: 83) | *Insolitis-<br>pirillum<br>peregrinum* | MRIIRPYGSSTVASPSPQDAQPLRSLQRQNGTEDVAEFSRRHPELVLAQWVAMLD<br>KIIRKPAPGKNSTALPRPTAEQRRLRQQVGAALWAEMQRHTPVPPELKAVWDSKV<br>HPYSKDNAPATAKTPSHRGRWYDREGDPETSAATVAEGVRRHLLDSAQPFRANG<br>GQPKGKGVIEHRALTIQNGTLLHHHQSEKAGPLPEDWSTYRADELVSTIGKDARW<br>IKVAASLYQHYGRIFGPTTPISEAQTRPEFVLHTAVKAYYRRLFKERKLPAERLERL<br>LPRTGEALRHAVTVQHGNRSLADAVRIGKILHYGWLQNGEPDPWPDDAALYSSR<br>YWGSDGQTDIKHSEAVSRVWRRALTAAQRTLTSWLYPAGTDAGDILLIGQKPDSI<br>DRNRLPLLYGDSTRHWTRSPGDVWLFLKQTLENLRNSSFHFKTLSAFTSHLDGTCE<br>SEPAEQQAAQALWQDDRQQDHQQVFLSLRALDATTYLPTGPLHRIVNAVQSTDA<br>TLPLPRFRRVVTRAANTRLKGFPVEPVNRRTMEDDPLLRCRYGVLKLLYERGFRA<br>WLETRPSIASCLDQSLKRSTKAAQTINGKNSPQGVEILSRATKLLQAEGGGGHGEH<br>DLFDRLYAATAREMRVQVGYHHDAEAARQQAEFIEDLKCEVVARAFCAYLKTLG<br>IQGDIIRRQPEPLPTWPDLPDLPSSTIGTAQAALYSVLHLMPVEDVGSLLHQLRRW<br>LVALQARGGEDGTAITATIPLLELYLNRHDAKFSGGGAGTGLRWDDWQVFFDCQ<br>ATFDRVFPPGPALDSHRLPLRGLREVLRFGRVNDLAALIGQDKITAAEVDRWHTA<br>EQTIAAQQQRREALHEQLSRKKGTDAEVDEYRALVTAIADHRHLTAHVTLSNVVR<br>LHRLMTTVLGRLVDYGGLWERDLTFVTLYEAHRLGGLRNLLSESRVNKFLDGQT<br>PAALSKKNNAEENGMISKVLGDKARRQIRNDFAHFNMLQQGKKTINLTDEINNAR<br>KLMAHDRKLKNAITRSVTTLLQQDGLDIVWTMDASHRLTDAKIDSRNAIHLHKTH<br>NRANIREPLHGKSYCRWVAALFGATSTPSATKKSDKIR |

TABLE 5

Cas1b

Cas13b orthologs

| | |
|---|---|
| *Paludibacter<br>propionicigenes* WB4<br>(NC_014734.1)<br>>WP_013446107<br>(SEQ ID NO: 84) | mktsanniyfnginsfkkifdskgaiapiaekscrnfdikaqndvnkeqrihyfavghtf<br>kqldtenlfeyvldenlrakrptrfislqqfdkefienikrlisdirninshyihrfdpl<br>kidavptniidflkesfelaviqiylkekginylqfsenphadqklvaflhdkflpldek<br>ktsmlqnetpqlkeykeyrkyfktlskqaaidqllfaeketdyiwnlfdshpvltisagk<br>ylsfysclfllsmflyksenangliskikgfkknntteeeekskreiftffskrfnsmdidse<br>enqlvkfrdlilylnhypvawnkdleldssnpamtdklkskiieleinrsfplyegnerf<br>alfakyqiwgkkhlgksiekeyinasftdeeitaytyetdtcpelkdahkkladlkaakg<br>lfgkrkeknesdikktetsirelqhepnpikdkliqrieknlltvsygrnqdrfmdfsar<br>flaeinyfgqdasfkmyhfyatdeqnselekyelpkdkkkydslldhqgklvhfisykeh<br>lkryeswddafviennaiqlklsfdgventvtiqralliylledalrniqnntaenagkq<br>llqeyyshnkadlsafkqiltqqdsiepqqktefkkllprrllnnyspainhlqtphssl<br>plilekallaektycslvvkakaegnyddfikrnkgkqfklqfirkawnlmyfrnsylqn<br>vqaaghhksfhierdefndfsrymfafeelsqykyylnemfekkgffennefkilfqsgt<br>slenlyektkqkfeiwlasntaktnkpdnyhlnnyeqqfsnqlfffinlshfinylkstgk<br>lqtdangqiiyealnnvqylipeyyytdkpersesksgnklynklkatkledallyemam<br>cylkadkqiadkakhpitklltsdvefnitnkegiqlyhllvpfkkidafiglkmhkeqq<br>dkkhptsflanivnylelvknndkdirktyeafstnpvkrtltyddlakidghlisksikf<br>tnvtleleryfifkeslivkkgnnidfkyiklgrnyynnekkknegirnkafhfgipdsk<br>sydqlirdaevmfianevkpthatkytdlnkqlhtvcdklmetvhndyfskegdgkkkre<br>aagqkyfeniisak |
| *Prevotella* sp. P5-60<br>(NZ_JXQJ01000080.1)<br>>WP_044074780.1<br>(SEQ ID NO: 85) | mnipalvenqkkyfgtysvmamlnaqtvldhiqkvadiegeqnennenlwfhpvmshlyn<br>akngydkqpektmfiierlqsyfpflkimaenqreysngkykqnrvevnsndifevlkra<br>fgvlkmyrdlinhyktyeeklidgceflttsteqpfsgmiskyytvalrntkerygykaed<br>lafiqdnrykfktkdaygkrksqvntgsflslqdyngdttlddhlsgvgialliclfldkq<br>yinlflsrlpifssynaqseerriiirsfginsikqpkdrihseksnksvamdmlnevkr<br>cpdelfttlsaekqsrfriissddhnevlmkrssdifvplllqyidygklfdhirfhvnmg<br>klryllkadktcidggqtrvrvieqpingfgrleevetmrkqengtfgnsgirirdfenmk<br>rddanpanypyivetythyilennkvemfisdeenptpllpvieddryvvktipscrmst<br>leipamafhmflfgsekteklliidvhdrykrlfqamqkeevtaeniasfgiaesdlpqki<br>mdlisgnahgkdvdafirltvddmltdterrikrfkddrksirsadnkmgkrgfkqistg<br>kladflakdivlfqpsyndgenkitglnyrimqqsaiavydsgddyeakqqfklmfekarl<br>igkgttephpflykvfvrsipanavdfyerylierkfyliglsneikkgnrvdvpfirrd |

TABLE 5-continued

Cas1b

Cas13b orthologs

| | |
|---|---|
| | qnkwktpamktlgriysedlpvelprqmfdneikshlkslpqmegidfnnanytyliaey<br>mkrvinddfqtfyqwkrnyrymdmlrgeydrkgslqhcftsieereglwkerasrtetyr<br>klasnkirsnrqmrnasseeietildkrlsncrneyqksekiirryrvqdallfllakkt<br>lteladfdgerfklkeimpdaekgilseimpmsfifekggkiytitsggmldknygdffv<br>lasdkrignllelvgsntvskedimeefkkydqcrpeissivfnlekwafdtypelpary<br>drkekvdfwsildvlsnnkdinneqsyilrkirnafdhnnypdkgiveikalpeiamsik<br>kafgeyaimk |
| *Prevotella* sp. P4-76<br>(NZ_JXQI01000021.1)<br>>WP_044072147.1 (SEQ<br>ID NO: 86) | mnipalvenqkkyfgtysvmamlnaqtvldhiqkvadiegeqnennenlwfhpvmshlyn<br>akngydkqpektmfiierlqsyfpflkimaenqreysngkykqnrvevnsndifevlkra<br>fgvlkmyrdqashyktydeklidgcefltsteqplsgminnyytvalrnmnetygykted<br>lafiqdkrfkfvkdaygkkksqvntgfflslqdyngdtqkklhlsgvgialliclfldkq<br>yiniflsrlpifssynaqseerriiirsfginsikqpkdrihseksnksvamdmlneikr<br>cpnelfetlsaekqsrfriisndhnevlmkrssdrfvplllgyidygklfdhirfhvnmg<br>klryllkadktcidgqtrvrvieqpingfgrleevetmrkqenglfgnsgirirrdfenmk<br>rddanpanypyivdtythyilennkvemfisdeetpapllpvieddryvvktipscrmst<br>leipamafhmflfgskkteklivdvhnrykrlfkamqkeevtaeniasfgiaesdlpqki<br>idlisgnahgkdvdafirltvddmladterrikrfkddrksirsadnkmgkrgfkqistg<br>kladflakdivlfqpsyndgenkitglnyrimqsaiavynsgddyeakqqfklmfekarl<br>igkgttephpflykvfvrsipanavdfyerylierkfyliglsneikkgnrvdvpfirrd<br>qnkwktpamktlgriyedlpvelprqmfdneikshlkslpqmegidfnnanytyliaey<br>mkrvinddfqtfyqwkrnyrymdmlrgeydrkgslqscftsveereglwkerasrtelyr<br>klasnkirsnrqmrnasseeietildkrlsnsrneyqksekvirryrvqdallfllakkt<br>lteladfdgerfklkeimpdaekgilseimpmsftfekggkkytitsegmklklknygdffv<br>lasdkrignllelvgsdtvskedimeefkkydqcrpeissivfnlekwafdtypelsarv<br>dreekvdfksilkillnnkninkeqsdilrkirnafdhnnypdkgvveiralpeiamsik<br>kafgeyaimk |
| *Prevotella* sp. P5-125<br>(NZ_JXQL01000055.1)<br>>WP_044065294.1 (SEQ<br>ID NO: 87) | mnipalvenqkkyfgtysvmamlnaqtvldhiqkvadiegeqnennenlwfhpvmshlyn<br>akngydkqpektmfiierlqsyfpflkimaenqreysngkykqnrvevnsndifevlkra<br>fgvlkmyrdltnhyktyeeklndgcefltsteqplsgminnyytvalrnmnerygykted<br>lafiqdkrfkfvkdaygkkksqvntgfflslqdyngdtqkklhlsgvgialliclfldkq<br>yiniflsrlpifssynaqseerriiirsfginsiklpkdrihseksnksvamdmlnevkr<br>cpdelfttlsaekqsffriisddhnevlmkrssdifvplllgyidygklfdhirfhvnmg<br>klryllkadktcidgqtrvrvieqpingfgrleeaetmrkqenglfgnsgirirrdfenmk<br>rddanpanypyivdtythyilennkvemfindkedsapllpviedchyvvktipscrmst<br>leipamafhmflfgskkteklivdvhnrykrlfqamqkeevtaeniasfgiaesdlpqki<br>ldlisgnahgkdvdafirltvddmltdterrikrfkddrksirsadnkmgkrgfkqistg<br>kladflakdivlfqpsyndgenkitglnyrimqsaiavydsgddyeakqqfklmfekarl<br>igkgttephpflykvfarsipanavefyerylierkfyltglsneikkgnrvdvpfirrd<br>qnkwktpamktlgriysedlpvelprqmfdneikshlkslpqmegidfnnanytyliaey<br>mkrvldddfqtfyqwnrnyrymdmlkgeydrkgslqhcftsveereglwkerasrteryr<br>kqasnkirsnrqmrnasseeietildkrlsnsrneyqksekvirryrvqdallfllakkt<br>lteladfdgerfklkeimpdaekgilseimpmsflfekggkkytitsegmklknygdffv<br>lasdkrignllelvgsdivskedimeefnkydqcrpeissivfnlekwafdtypelsarv<br>dreekvdfksilkillnnkninkeqsdilrkirnafdhnnypdkgvveikalpeiamsik<br>kafgeyaimk |
| *Prevotella* sp. P5-119<br>(NZ_JXQK01000043.1)<br>>WP_042518169.1 (SEQ<br>ID NO: 88) | mnipalvenqkkyfgtysvmamlnaqtvldhiqkvadiegeqnennenlwfhpvmshlyn<br>akngydkqpektmfiierlqsyfpflkimaenqreysngkykqnrvevnsndifevlkra<br>fgvlkmyrdltnhyktyeeklidgcefltsteqplsgmiskyytvalrntkerygykted<br>lafiqdnikkitkdaygkrksqvntgifislqdyngdtqkklhlsgvgialliclfldkq<br>yiniflsrlpifssynaqseerriiirsfginsiklpkdrihseksnksvamdmlnevkr<br>cpdelfttlsaekqslfriissdhnevlmkrstdifvplllqyidygklfdhilfhvnmg<br>klryllkadktcidgqtrvrvieqplngfgrleeaetmrkqengtfgnsgirirrdfenvk<br>rddanpanypyivdtythyilennkvemfisdkgssapllplieddryvvktipscrmst<br>leipamafhmflfgskkteklivdvhnrykrlfqamqkeevtaeniasfgiaesdlpqki<br>ldlisgnahgkdvdafirltvddmltdterrikrfkddrksirsadnkmgkrgfkqistg<br>kladflakdivlfqpsyndgenkitglnyrimqsaiavydsgddyeakqqfklmfekarl<br>igkgttephpflylwfarsipanavdfyerylierkfyltglcneikrgnrvdvpfirrd<br>qnkwktpamktlgriysedlpvelprqmfdneikshlkslpqmegidfnnanvtyliaey<br>mkrvinddfqtfyqwkrnyhymdmlkgeydrkgslqhcftsveereglwkerasrtelyr<br>klasnkirsnrqmrnasseeietildkrlsncrneyqksekvirryrvqdallfllakkt<br>lteladfdgerfklkeimpdaekgilseimpmsflfekggkkytitsegmklknygdffv<br>lasdkrignllelvgsdivskedimeefnkydqcrpeissivfnlekwafdtypelsarv<br>dreekvdfksilkillnnkninkeqsdilrkirnafdhnnypdkgiveikalpeiamsik<br>kafgeyaimk |
| *Capnocytophaga<br>canimorsus* Cc5<br>(NC_015846.1)<br>>WP_013997271.1<br>(SEQ ID NO: 89) | mkniqrlgkgnefspfkkedkfyfggflnlannniedfffkeiitrfgivitdenkkpet<br>fgekilneifkkdisivdyekwvnifadyfpftkylslyleemqfknrvicfrdvmkell<br>ktvealrnfythydhepikiedrvlyfldkvlldvsltvknkylktdktkeflnqhigee<br>lkelcqqrkdylvgkgkridkeseiiingiynnafkdfickrekqddkenhnsvekilcnk<br>epqnkkqkssatvwelcsksssskyteksfpnrendkhclevpisqkgivfllsfflnkge<br>iyaltsnikgfkakitkeepvtydknsirymathrmfsflaykglrkrkirtseinynedg<br>qasstyeketlmlqmldelnkvpdvvyqnlsedvqktfiedwneylkenngdvgtmeeeq<br>vihpvirkryedkfnyfairfldefaqfptlrfqvhlgnylcdkrtkqicdttterevkk |

TABLE 5-continued

Cas1b

Cas13b orthologs

|  | kitvfgrlselenkkaiflnereeikgwevfpnpsydfpkenisvnykdfpivgsildre
kqpvsnkigirvkiadelqreidkaikekklrnpknrkanqdekqkerlvneivstnsne
qgepvvfigqptaylsmndihsvlyeflinkisgealetkivekietqikqiigkdattk
ilkpytnansnsinrekllrdleqeqqilkttlleeqqqrekdkkdkkskrkhelypsekg
kvavwlandikffmpkafkeqwrgyhhsllqkylayyeqskeelknllpkevfkhfpfkl
kgyfqqqylnqfytdylkrrlsyvnelllniqnflmdkdalkatekecfkffrkqnyiin
piniqiqsilvypiflkrgfldekptmidreldkenkdteladwfmhyknykednyqkfy
ayplekveekeldkrnkqinkqkkndvytlmmveyriqkifgdkfveenplvlkgifqsk
aerqqnnthaattqernlngilnqpkdikiqgkitvkgvklkdignfrkyeidqrvntfl
dyeprkewmaylpndwkekekqgqlppnnvidrqiskyetvrskillkdvqelekiisde
ikeehrhdlkqgkyynfkyyilngllrqlknenvenykvfklntnpekvnitqlkqeatd
leqkafvltyirnkfahnqlpkkefwdycqekygkiekektyaeyfaevfkrekealik |
|---|---|
| Phaeodactylibacter
xiamenensis
(NZ_JPOSO1000018.1)
>WP_044218239.1
(SEQ ID NO: 90) | mtntpkrrtlhrhpsyfgaflniarhnafmimehlstkydmedknfideaqlpnaklfgc
lkkrygkpdvtegvsrdlrryfpflnyplflhlekqqnaeqaatydinpediefttlkgff
rllnqmmnyshyisntdygkfdldpvqdryeaaifrlldrglchtkffdvfeskhtrhle
snnseyrprslanspdhentvafvtclflerkyafpflsrldcfrstndaaegdplirka
shecytmfccrlpqpklessdilldmvnelgrcpsalynllseedqarfhikreeitgfe
edpdeeleqeivlkrhsdrfpyfalryfddteafqtlrfdvylgrwrtkpvykkriygqe
rdrvliqsirtftrlsrllpiyenvkhdavrqneedgklvnpdvtsqfhkswiqiesddr
aflsdriehfsphynfgdqviglkfinpdryaaiqnvfpklpgeekkdkdaklvnetada
iistheirslflyhylskkpisagderrfiqvdtetfikqyidtiklffediksgelqpi
adppnyqkneplpyvrgdkektqeeraqyrerqkeikerrkelntllqnryglsiqyips
rlreyllgyldvpyeklalqklraqrkevkkrikdiekmrtprvgeqatwlaedivfltp
pkmhtperkttkhpqklnndqfrimqsslayfsvnkkaikkffqketgiglsnretshpf
lyridvgrcrgildfytgylkykmdwlddaikkvdnrkhgkkeakkyekylpssiqhktp
leldytrlpvylprglfkkaivkalaahadfqvepeednvifcldqlldgdtqdfynwqr
yyrsalteketdnqlvlahpyaeqilgtiktlegkqknnldgnkakqkikdelidlkrak
rrlldreqylravqaedralwlmiqerqkqkaeheerafdqldlknitkiltesidarlr
ipdtkvditdklplrrygdlrrvakdttlvnlasyyhvaglseipydlvkkeleeydrrr
vaffehvyqfekevydryaaelrnenpkgestyfshweyvavavkhsadthfnelfkekv
mqlrnkfhhnefpyfdwllpevekasaalyadrvfdvaegyyqkmrklmrq |
| Porphyromonas
gingivalis W83
(NC_002950.2)
>WP_005873511.1
(SEQ ID NO: 91) | mntvpasenkgqsrtveddpqyfglylnlarenlieveshvrikfgkkldneeslkqsll
cdhllsvdrwtkvyghsrrylpflhyfdpdsqiekdhdsktgvdpdsaqrlirelyslld
flrndfshnrldgttfehlevspdissfitgtyslacgraqsffadfflcpddfvlaknrk
eqlisvadgkecltvsglafficlfldreqasgmlsrirgfkrtdenwaravhetfcdlc
irhphdrlessntkealllldmlnelnrcprilydmlpeeeraqflpaldensmnnlsens
lneesrllwdgssdwaealtkrirhqdffpylmlffieemdllkgirfixdlgeieldsy
skkvgmgeydrtitdhalafgklsclfqneeevsrmisgeasypvrfslfapryarydnk
igychtsdpvypksktgekralsnpqsmgfisvhnlrklllmellcegsfsrmqsdflrk
anrildetaegklqfsalfpemrhrfippqnpksdrrekaettlekykqeikgrkdldn
sqllsafdmnqrqlpsrlldewmnirpashsvklrtyvkqlnedcrlrlrkfrkdgdgka
raiplvgemafflsqdivrmiiseetkklitsayynemqrslaqyageenrrqfraivae
lhllpdssghpflsatmetahrytedfykcylekkrewlaktfyrpeqdentkrrisvff
vpdgearkllpllirrrmkeqndlqdwirnkqahpidlpshlfdskimellkvkdgkkkw
neafkdwwstkypdgmqpfyglrrelnihgksysyipsdgkkfadcythlmektvqdkkr
elrtagkpvppdlaadikrsfhravnerefmlrlvqeddrlmlmainkmmtdreedilpg
lkniidsildeenqfslavhakvlekegeggdnslslvpatierkskrkdwskyiryrydr
rvpglmshfpehkatldevktllgeydrcrikifdwafalegaimsdrdlkpylhesssr
egksgehstlvkmlvekkgcltpdesqyliliirnkaahnqfpcaaempliyrdvsakvgs
iegssakdlpegsslvdslwkkyemiirkilpildpenrffgkllnnmsqpindl |
| Porphyromonas
gingivalis F0570
(NZ_KI259168.1)
>WP_021665475.1
(SEQ ID NO: 92) | mntvpasenkgqsrtveddpqyfglylnlarenlieveshvrikfgkkldneeslkqsll
cdhllsvdrwtkvyghsrrylpflhyfdpdsqiekdhdsktgvdpdsaqrlirelyslld
flrndfshnrldgttfehlevspdissfitgtyslacgraqsffadffkpddfvlaknrk
eqlisvadgkecltvsglafficlfldreqasgmlsrirgfkrtnenwaravhetfcdlc
irhphdrlessntkealllldmlnelnrcprilydmlpeeeraqflpaldensmnnlsens
lneesrllwdgssdwaealtkrirhqdrfpylmlrfieemdllkgirfrvdlgeieldsy
skkvgmgeydrtitdhalafgklsclfqneeevsrmisgeasypvrfslfapryarydnk
igychtsdpvypksktgekralsnpqsmgfisvhdlrklllmellcegsfsrmqsgflrk
anrildetaegklqfsalfpemrhrfippqnpksdrrekaettlekykqeikgrkdkln
sqllsafdmnqrqlpsrlldewmnirpashsvklrtyvkqlnedcrifirkfrkdgdgka
raiplvgemafflsqdivrmiiseetkklitsayynemqrslaqyageenrrqfraivae
lhllpdssghpflsatmetahrytedfykcylekkrewlaktfyrpeqdentkrrisvff
vpdgearkllpllirrrmkeqndlqdwirnkqahpidlpshlfdskimellkvkdgkkkw
neafkdwwstkypdgmqpfyglrrelnihgksysyipsdgkkfadcythlmektvqdkkr
elrtagkpvppdlaadikrsfhravnerefmtrlvqeddrlmlmainkmmtdreedilpg
lkniidsildkenqfslavhakvlekegeggdnststvpatieikskrkdwskyirytydr
rvpglmshfpehkatldevktllgeydrcrikifdwafalegaimsdrdlkpythesssr
egksgehstlvkmlvekkgcltpdesqyliliirnkaahnqfpcaaempliyrdvsakvgs
iegssakdlpegsslvdslwkkyemiirkilpildhenrffgkllnnmsqpindl |
| Porphyromonas
gingivalis ATCC 33277
(NC_010729.1) | mntvpasenkgqsrtveddpqyfglylnlarenlieveshvrikfgkkklneestkqsll
cdhllsvdrwtkvyghsrrylpflhyfdpdsqiekdhdsktgvdpdsaqrlirelystld
flmclfshnrldgttfehlevspdissfitgtyslacgraqsrfavffkpddfvlaknrk |

TABLE 5-continued

| Cas1b | |
|---|---|
| Cas13b orthologs | |
| >WP_012458151.1<br>(SEQ ID NO: 93) | eqlisvadgkecltvsgfafficlfldreqasgmlsrirgfkrtdenwaravhetfcdlc<br>irhphdrlessntkealltdmlnelnrcprilydmlpeeeraqflpaldensmnntsens<br>ldeesrllwdgssdwaealtkrirhqdrfpylmlrfieeemdllkgirfrvdlgeieldsy<br>skkvgmgeydrtitdhalafgklsclfqneeevsrmisgeasypvrfstfaptyaiydnk<br>igychtsdpvypksktgekralsnpqsmgfisvhdlrklllmellcegsfsrmqsdflrk<br>anrildetaegklqfsalfpemrhrfippqnpkskdrrekaettlekykqeikgrkdkln<br>sqllsafdmdqrqlpsrlldewmnirpashsvklrtyvkqlnedcrlrlrkfrkdgdgka<br>raiplvgematflsqdivrmiiseetkklitsayynemqrslaqyageenrrqfraivae<br>lrlldpssghpflsatmetahrytegfykcylekkrewlakifyrpeqdentkrrisvff<br>vpdgearkllptlirrmkeqndlqdwirnkqahpidlpshlfdskvmelllcvkdgkkkw<br>neafkdwwstkypdgmqpfyglrrelnihgksysyipsdgkkfadcythlmektvrdkkr<br>elrtagkpvppdlaadikrsfhravnerefmtrlvqeddrlmlmainkmmtdreedilpg<br>lknidsildeenqfslavhakvlekegeggdnststvpatieikskrkdwskyirytydr<br>rvpglmshfpehkatldevktllgeydrcrikifdwafalegaimsdrdtkpythesssr<br>egksgehstlvkmlvekkgcltpdesqyililrnkaahnqfpcaaempliyrdvsakvgs<br>iegssakdlpegsslvdslwkkyemiirkilpildpenrffgkllnnmsqpindl |
| Porphyromonas<br>gingivalis F0185<br>(AWVC01000122.1)<br>>ERJ81987.1<br>(SEQ ID NO: 94) | mntvpasenkgqsrtveddpqyfglylnlarentieveshvrikfgkkklneestkqsll<br>cdhllsvdrwtkvyghsrrylpflhyfdpdsqiekdhdsktgvdpdsaqrlirelyslld<br>flrndfshnrldgttfehlevspdissfitgtyslacgraqsrfadffkpddfvlaknrk<br>eqlisvadgkeclivsglafficlfldreqasgmlsrirgfkrtdenwaravhetfcdlc<br>irhphdrlessntkeallldmlnelnrcprilydmlpeeeraqflpaldensmnntsens<br>lneesrllwdgssdwaealtkrirhqdrfpylmlrfieeemdllkgirfivdtgeieldsy<br>skkvgmgeydrtitdhalafgklsclfqneeevsrmisgeasypvrfstfaptyaiydnk<br>igychtsdpvypksktgekralsnpqsmgfisvhdlrklllmellcegsfsrmqsgflrk<br>anrildetaegklqfsalfpemrhrfippqnpkskdrrekaettlekykqeikgrkdkln<br>sqllsafdmnqrqlpsrlldewmnirpashsvklrtyvkqlnedcrifirkfrkdgdgka<br>raiplvgematflsqdivrmiiseetkklitsayynemqrslaqyageenrrqfraivae<br>lhlldpssghpflsatmetahrytedfykcylekkrewlaktfyrpeqdentkrrisvff<br>vpdgearkllpllirrrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpvppdlaadikrsfhravnerefmtrlvqeddrlmlmainkmmtdreedilpg<br>lknidsildeenqfslavhakvlekegeggdnststvpatieikskrkdwskyitytydr<br>rvpglmshfpehkatldevktllgeydrcrikifdwafalegaimsdrdtkpythesssr<br>egksgehstlvkmlvekkgcltpdesqyililrnkaahnqfpcaaempliyrdvsakvgs<br>iegssakdlpegsslvdslwkkyemiirkilpildhenrffgkllnnmsqpindl |
| Porphyromonas<br>gingivalis F0185<br>(NZ_KI259960.1)<br>>WP_021677657.1<br>(SEQ ID NO: 95) | mntvpasenkgqsrtveddpqyfglylnlarentieveshvrikfgkkklneestkqsll<br>cdhllsvdrwtkvyghsrrylpflhyfdpdsqiekdhdsktgvdpdsaqrlirelyslld<br>flrndfshnrldgttfehlevspdissfitgtyslacgraqstfadffkpddfvlaknrk<br>eqlisvadgkecltvsglafficlfldreqasgmlsrirgfkrtdenwaravhetfcdlc<br>irhphdrlessntkeallldmlnelnrcprilydmlpeeeraqflpaldensmnntsens<br>lneesrllwdgssdwaealtkrirhqdrfpylmltfieeemdllkgirfivdlgeieldsy<br>skkvgmgeydrtitdhalafgklsclfqneeevsrmisgeasypvifstfapryaiydnk<br>igychtsdpvypksktgekralsnpqsmgfisvhdlrklllmellcegsfsrmqsgflrk<br>anrildetaegklqfsalfpemrhrfippqnpkskdrrekaettlekykqeikgrkdkln<br>sqllsafdmnqrqlpsrlldewmnirpashsvklrtyvkqlnedcrlrlrkfrkdgdgka<br>raiplvgematflsqdivrmiiseetkklitsayynemqrslaqyageenrrqfraivae<br>lhlldpssghpflsatmetahytedfykcylekkrewlaktfyrpeqdentkrrisvff<br>vpdgearkllpllirrrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpvppdlaadikrsfhravnerefmtrlvqeddrlmlmainkmmtdreedilpg<br>lknidsildeenqfslavhakvlekegeggdnststvpatieikskrkdwskyirytydr<br>rvpglmshfpehkatldevktllgeydrcrikifdwafalegaimsdrdlkpylhesssr<br>egksgehstlvkmlvekkgcltpdesqylilirnkaahnqfpcaaempliyrdvsakvgs<br>iegssakdlpegsslvdslwkkyemiirkilpildhenrffgkllnnmsqpindl |
| Porphyromonas<br>gingivalis SJD2<br>(NZ_KI629875.1)<br>>WP_023846767.1<br>(SEQ ID NO: 96) | mntvpasenkgqsrtveddpqyfglylnlarenlieveshvrikfgkkklneestkqsll<br>cdhllsvdrwtkvyghsrrylpflhyfdpdsqiekdhdsktgvdpdsaqrlirelyslld<br>flrndfshnrldgttfehlevspdissfitgtyslacgraqsrfadffkpddfvlaknrk<br>eqlisvadgkecltvsglaffictfldreqasgmlsrirgfkrtdenwaravhelfcdlc<br>irhphdrlessntkeallldmlnelnrcprilydmlpeeeraqflpaldensmnntsens<br>lneesrllwdgssdwaealtkrirhqdrfpylmlrfieeemdllkgirfivdlgeieldsy<br>skkvgmgeydrtitdhalafgklsclfqneeevsrmisgeasypvrfstfaptyaiydnk<br>igychtsdpvypksktgekralsnprsmgfisvhdlrklllmellcegsfsrmqsdflrk<br>anrildetaegklqfsalfpemrhrfippqnpkskdrrekaettlekykqeikgrkdkln<br>sqllsafdmnqrqlpsrlldewmnirpashsvklrtyvkqlnedcrlrlrkfrkdgdgka<br>raiplvgemalflsqdivrmiiseetkklitsayynemqrslaqyageenrrqfraivae<br>lhlldpssghpflsatmetahrytedfykcylekkrewlaktfyrpeqdentkrrisvff<br>vpdgearkllpllirrrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpvppdlaadikrsfhravnerefmtrlvqeddrlmlmainkmmtdreedilpg<br>lknidsildeenqfslavhakvlekegeggdnststvpatieikskrkdwskyirytydr<br>rvpglmshfpehkatldevktllgeydrcrikifdwafalegaimsdrdtkpythesssr<br>egksgehstlvkmlvekkgcltpdesqylilirnkaahnqfpcaaempliyrdvsakvgs<br>iegssakdlpegsslvdslwkkyemiirkilpildpenrffgkllnnmsqpindl |

TABLE 5-continued

| Cas1b |  |
|---|---|
| Cas13b orthologs | |
| Porphyromonas gingivalis F0568 (AWUU01000145.1) >ERJ65637.1 (SEQ ID NO: 97) | mntvpasenkgqsrtveddpqyfglylnlarenlieveshvrikfgkkklneestkqsll cdhltsvdrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglafficttfldreqasgmlsrirgfkrtdenwaravhelfcdlc irhphdrlessntkealltdmlnelnrcprilydmlpeeeraqflpaldensmnntsens lneesrllwdgssdwaealtkrirhqdrfpylmlrfieemdllkgirfivdlgeieldsy skkvgmgeydrtitdhalafgklsclfqneeevsrmisgeasypvrfstfaptyaiydnk igychtsdpvypksktgekralsnprsmgfisvhdlrklllmellcegsfsrmqsdflrk anrildetaegklqfsalfpemrhrfippqnpkskdn-ekaettlekykqeikgrkdkln sqllsafdmdqrqlpsrlldewmnirpashsvklrtyvkqlnedcrlrlqkfrkdgdgka raiptvgemalftsqdivrmiiseetkklitsayynemqrslaqyageenrhqfraivae lrlldpssghpflsatmetahrytedfykcylekkrewlaktlyrpeqdentkrrisvff vpdgearkllpllirrrmkeqndlqdwirnkqahpidlpshlfdskimellkvkdgkkkw neafkdwwstkypdgmqpfyglrrelnihgksysyipsdgkkfadcythlmektvqdkkr elrtagkpvppdlaadikrsfhravnerefmtrlvqeddrlmlmainkmmtdreedilpg lknidsildeeenqfslavhakvlekegeggdnststvpatieikskrkdwskyirytydr rvpglmshfpehkatldevktllgeydrcrikifdwafalegaimsdrdtkpythesssr egksgehstlvkmlvekkgcltpdesqylilirnkaahnqfpcaaempliyrdvsakvgs iegssakdlpegsslvdslwkkyemiirkilpildpenrffgkllnnmsqpindl |
| Porphyromonas gingivalis W4087 (AWVE01000130.1) >ERJ87335.1 (SEQ ID NO: 98) | mntvpasenkgqsrtveddpqyfglylnlarenlieveshvrikfgkkklneestkqsll cdhltsvdrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglaffictfldreqasgmlsrirgfkrtdenwaravhelfcdlc irhphdrlessntkealltdmlnelnrcprilydmlpeeeraqflpaldensmnntsens lneesrllwdgssdwaealtkrirhqdrfpylmlrfieemdllkgirfivdtgeieldsy skkvgmgeydrtitdhalafgklsclfqneeevsrmisgeasypvrfstfaptyaiydnk igychtsdpvypksktgekralsnprsmgfisvhdlrklllmellcegsfsrmqsdflrk anrildetaegklqfsalfpemrhrfippqnpkskdrrekaettlekykqeikgrkdkln sqllsafdmdqrqlpsrlldewmnirpashsvklrtyvkqlnedcrlrlqkfrkdgdgka raiptvgemalftsqdivrmiiseetkklitsayynemqrslaqyageenrhqfraivae lrlldpssghpflsatmetahrytedfykcylekkrewlaktlyrpeqdentkrrisvff vpdgearkllptlim-mkeqndlqdwirnkqahpidlpshlfdskvmelllcvkdgkkkw neafkdwwstkypdgmqpfyglrrelnihgksysyipsdgkkfadcythlmektvrdkkr elrtagkpvppdlaayikrsfhravnerefmtrlvqeddrlmlmainkimtdreedilpg lknidsildkenqfslavhakvlekegeggdnststvpatieikskrkdwskyirytydr rvpglmshfpehkatldevktllgeydrcrikifdwafalegaimsdrdlkpylhesssr egksgehstlykmlyekkgcltpdesqylilirnkaahnqfpcaaeipliyrdvsakvgs iegssakdlpegsslvdslwkkyemiirkilpildpenrffgklinnmsqpindl |
| Porphyromonas gingivalis W4087 (NZ_KI260263.1) >WP_021680012.1 (SEQ ID NO: 99) | mntvpasenkgqsrtveddpqyfglylnlarenlieveshyrikfgkkklneeslkqsll cdhllsydrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfedlc irhphdrlessntkeallldmlnelnrcprilydmlpeeeraqflpaldensmnnlsens lneesrllwdgssdwaealtkrirhqdrfpylmlifieemdllkgirfrvdlgeieldsy skkvgrngeydrtitdhalafgklsdfqneeevsrmisgeasypyrfslfaptyaiydnk igychtsdpyypksktgekralsnprsmgfisvhdlrkillmellcegsfsrmqsdflrk am-ildetaegklqfsalfpemrhrfippqnpkskdrrekaettlekykqeikgrkdkln sqllsafdmdqrqlpsrlldewmnirpashsvklrtyvkqlnedcrlrlqkfrkdgdgka raiplygematilsqdivrmiiseetkklitsayynemqrslaqyageenrhqfraivae lrlldpssghpflsatmetahrytedfykcylekkrewlaktfyrpeqdentkrrisvff vpdgearkllpllirrrmkeqndlqdwirnkqahpidlpshlfdskvmellkvkdgkkkw neafkdwwstkypydgmqpfyglrrelnihgksysyipsdgkkfadcythlmektvrdkkr elrtagkpyppdlaayikrsfhravnerefmlrlvqeddrlmlmainkimtdreedilpg lknidsildkenqfslavhakvlekegeggdnslslypatieikskrkdwskyirytydr rvpglmshfpehkatldevktllgeydrcrikifdwafalegaimsdrdlkpylhesssr egksgehstlykmlyekkgcltpdesqylilirnkaahnqfpcaaeipliyrdvsakvgs iegssakdlpegsslvdslwkkyemiirkilpildpenrffgkllnnmsqpindl |
| Porphyromonas gingivalis F0568 (NZ_KI258981.1) >WP_021663197.1 (SEQ ID NO: 100) | mntvpasenkgqsrtveddpqyfglylnlarenlieveshyrikfgkkklneeslkqsll cdhllsydrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfedlc irhphdrlessntkeallldmlnelnrcprilydmlpeeeraqflpaldensmnnlsens lneesrllwdgssdwaealtkrirhqdrfpylmlfieemdllkgirfrvdlgeieldsy skkvgingeydrtitdhalafgklsdfqneeevsrmisgeasypyrfslfaptyaiydnk igychtsdpyypksktgekralsnprsmgfisvhdlrkillmellcegsfsrmqsdflrk anrildetaegklqfsalfpemrhrfippqnpkskdrrekaettlekykqeikgrkdkln sqllsafdmdqrqlpsrlldewmnirpashsvklrtyvkqlnedcrlrlqkfrkdgdgka raiplygematilsqdivrmiiseetkklitsayynemqrslaqyageenrhqfraivae lrlldpssghpflsatmetahrytedfykcylekkrewlaktfyrpeqdentkrrisvff vpdgearkllpllirrrmkeqndlqdwirnkqahpidlpshlfdskimellkvkdgkkkw neafkdwwstkypdgmqpfyglrrelnihgksysyipsdgkkfadcythlmektvqdkkr elrtagkpyppdlaadikrsfhravnerefmlrlvqeddrlmlmainkmmtdreedilpg |

TABLE 5-continued

| Cas1b |
| --- |
| Cas13b orthologs |

|  |  |
| --- | --- |
|  | lknidsildeenqfslavhakvlekegeggdnslslypatieikskrkdwskyirytydr<br>rvpglmshfpehkatldevktllgeydrcrikifdwafalegaimsdrdlkpylhesssr<br>egksgehstlykmlyekkgcltpdesqylilirnkaahnqfpcaaempliyrdvsakvgs<br>iegssakdlpegsslvdslwkkyemiirkilpildpenrffgkllnnmsqpindl |
| *Porphyromonas<br>gingivalis*<br>(NZ_LOEL01000010.1)<br>>WP_061156637.1<br>(SEQ ID NO: 101) | mntvpasenkgqsrtveddpqyfglylnlarenlieveshyrikfgkkklneeslkqsll<br>cdhllsydrwtkvyghsrrylpflhyfdpdsqiekdhdsktgvdpdsaqrlirelyslld<br>flmdfshnrldgttfehlevspdissfitgtyslacgraqsrfadffkpcldfvlaknrk<br>eqlisvadgkecltvsglafficlfldreqasgmlsrirgfkrtdenwaravhetfedlc<br>irhphdrlessntkealllldmlnelnrcprilydmlpeeeraqflpaldensmnnlsens<br>lneesrllwdgssdwaealtkrirhqdrfpylmlrfieemdllkgirfrvdlgeieldsy<br>skkvgingeydrtitdhalafgklsdfqneeevsrmisgeasypyrfslfaptyaiydnk<br>igychtsdpyypksktgekralsnpqsmgfisvhdlrkillmellcegsfsrmqsgflrk<br>anrildetaegklqfsalfpemrhrfippqnpkskdn-ekaettlekykqeikgrkdkln<br>sqllsafdmnqrqlpsrlldewmnirpashsvklrtyvkqlnedcrifirkfrkdgdgka<br>raiplvgematflsqdivrmiiseetkklitsayynemqrslaqyageenrrqfraivae<br>lhllldpssghpflsatmetahrytedfykcylekkrewlaktfyrpeqdentkrrisvff<br>vpdgearkllplllirrrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpyppdlaadikrsfhravnerefmlrlyqeddrlmlmainkmmtdreedilpg<br>lknidsildkenqfslavhakvlekegeggdnslslypatieikskrkdwskyirytydr<br>rvpglmshfpehkatldevktllgeydrcrikifdwafalegaimsdrdlkpylhesssr<br>egksgehstlykmlyekkgcltpdesqylilirnkaahnqfpcaaempliyrdvsakvgs<br>iegssakdlpegsslvdslwkkyemiirkilpildpenrffgkllnnmsqpindl |
| *Porphyromonas<br>gulae*<br>(NZ_JRAQ01000019.1)<br>>WP_039445055.1<br>(SEQ ID NO: 102) | mntvpatenkgqsrtveddpqyfglylnlarenlieveshvrikfgkkklneeslkqsll<br>cdhllsidrwtkvyghsrrylpflhcfdpdsgiekdhdsktgvdpdsaqrlirelyslld<br>flmclfshnrldgttfehlkvspdissfitgaylfaceraqsrfadffkpddfllaknrk<br>eqlisvadgkecltvsgfafficlfldreqasgmlsrirgfkrtdenwaravhetfcdlc<br>irhphdrlessntkealllldmlnelnrcprilydmlpeeeraqflpaldensmnnlsens<br>lneesrllwdgssdwaealtkrirhqdrfpylmlrfieemdllkgirfrvdlgeieldsy<br>skkvgmgeydrtitdhalafgklsclfqneeevsrmisgeasypvrfslfaplyaiydnk<br>igychtsdpvypksktgekralsnpqsmgfisvhdlrklllmellcegsfsrmqsdflrk<br>anrildetaegklqfsalfpemrhrfippqnpkskdrrekaettlekykqeikgrkdkln<br>sqllsafdmnqrqlpsrlldewmnirpashsvklrtyvkqlnedcrifirkfrkdgdgka<br>raiplvgematflsqdivrmiiseetkklitsayynemqrslaqyageenrrqfraivae<br>lhllldpssghpflsatmetahrytedfykcylekkrewlaktfyrpeqdentkrrisvff<br>vpdgearkllplllirrrmkeqndlqdwirnkqahpidlpshlfdskimellkykdgkkkw<br>neafkdwwstkypdgmqpfyglrrelnihgksysyipsdgkkfadcythlmektvrdkkr<br>elrtagkpvppdlaayikrsfhravnerefmlrlvqeddrlmlmainkmmtdreedilpg<br>lknidsildeenqfslavhakvlekegeggdnslslvpatieikskrkdwskyilyiydr<br>rvpglmshfpehkatldevktllgeydrcrikifdwafalegaimsdrdlkpylhesssr<br>egksgehstlvkmlvekkgcltpdesqylilirnkaahnqfpcaaempliyrdvsakvgs<br>iegssakdlpegsslvdslwkkyemiirkilpildhenrffgkllnnmsqpindl |
| *Bacteroides pyogenes*<br>F0041 (KE993153.1)<br>>ERI81700.1<br>(SEQ ID NO: 103) | mesiknsqkstgktlqkdppyfglylnmallnvrkvenhirkwlgdvallpeksgfhsll<br>ttdnlssakwtrfyyksrkflpflemfdsdkksyenrrettecldtidrqkisslllkevy<br>gklqdirnafshyhiddqsvkhtaliissemhrfienaysfalqktrarftgvfvetdfl<br>qaeekgdnkkffaiggnegiklkdnalifliclfldreeafkflsratgfkstkekgfla<br>vrelfcalccrqpherllsvnpreallmdmlnelnrcpdilfemldekdqksflpllgee<br>eqahilenslndelceaiddpfemiaslskrvryknrfpylmlryieeknllpfirfrid<br>lgclelasypkkmgeennyersvtdhamafgrltdfhnedavlqqitkgitdevrfslya<br>pryaiynnkigfvrtggsdkisfptlkkkggeghcvaytlqntksfgfisiydlrkilll<br>sfldkdkaknivsglleqcekhwkdlsenlfdairtelqkefpvpliryltlprskggklv<br>sskladkqekyeseferrkeklteilsekdfdlsqiprrmidewlnvlptsrekklkgyv<br>etlkldcrerlrvfekrekgehpvpprigematdlakdiirmvidqgvkqritsayysei<br>qrclaqyagddnrrhldsiirelrlkdtknghpflgkvlrpglghteklyqryfeekkew<br>leatfypaaspkrvprfvnpptgkqkelpliirnlmkerpewrdwkqrknshpidlpsql<br>feneicrllkdkigkepsgklkwnemfklywdkefpngmqrfyrckrrvevfdkvveyey<br>seeggnykkyyealidevvrqkissskekskqvedltlsvrrvfkrainekeyqlrllc<br>eddrllfmavrdlydwkeaqldldkidnmlgepvsysqviqleggqpdavikaecklkdv<br>sklmrycydgrvlglmpyfanheatqeqvemelrhyedhrrrvfnwvfaleksvlkenekl<br>rrfyeesqggcehrrcidalrkaslvseeeyeflvhitnksahnqfpdleigklppnvts<br>gfceciwskykaiicriipfidperrffgklleqk |
| *Bacteroides pyogenes*<br>JCM 10003<br>(NZ_BAIU01000001.1)<br>>WP_034542281.1<br>(SEQ ID NO: 104) | mesiknsqkstgktlqkdppyfglylnmallnvrkvenhirkwlgdvallpeksgfhsll<br>ttdnlssakwtrfyyksrkflpflemfdsdkksyenrretaecldtidrqkisslllkevy<br>gklqdirnafshyhiddqsvkhtaliissemhrfienaysfalqktrarftgvfvetdfl<br>qaeekgdnkkffaiggnegiklkdnalifliclfldreeafkflsratgfkstkekgfla<br>vretfcalccrqpherllsvnpreallmdmlnelnrcpdilfemldekdqksflpllgee<br>eqahilenslndelceaiddpfemiaslskrvryknrfpylmlryieeknllpfirfrid<br>lgclelasypkkmgeennyersvtdhamafgrltdfhnedavlqqitkgitdevrfslya<br>plyaiynnkigfvrtgsdkisfpfikkkggeghcvaytlqntksfgfisiydlrkilll<br>sfldkdkaknivsglleqcekhwkdlsenlfdairtelqkefpvpliryltlprskggklv<br>sskladkqekyeseferrkeklteilsekdfdlsqiprrmidewlnvlptsrekklkgyv<br>etlkldcrerlrvfekrekgehplpprigematdlakdiirmvidqgvkqritsayysei |

TABLE 5-continued

Cas1b

Cas13b orthologs

| | |
|---|---|
| | qrclaqyagddnrrhldsiirelrlkdtknghpflgkvlrpglghteklyqryfeekkew<br>leatfypaaspkrvprfvnpptgkqkelpliirnlmkerpewrdwkqrknshpidlpsql<br>feneicrllkdkigkepsgklkwnemfklywdkefpngmqrfyrckrrvevfdkvveyey<br>seeggnykkyyealidevvrqkissskeksklqvedltlsvrrvfkrainekeyqlrllc<br>eddrllfmavrdlydwkeaqldldkidnmlgepvsysqviqleggqpdavikaecklkdv<br>sklmrycydgrvlglmpyfanheatqeqvemelrhyedhrrrvfnwvfaleksvlknekl<br>rrfyeesqggcehrrcidalrkaslvseeeyeflvhirnksahnqfpdleigklppnvts<br>gfceciwskykaiicriipfidperrffgklleqk |
| *Alistipes* sp. ZOR0009<br>(NZ_JTLD01000029.1)<br>>WP_047447901.1<br>(SEQ ID NO: 105) | msneigafrehqfayapgnekqeeatfatyfnlalsnvegmmfgevesnpdkieksldtl<br>ppailrqiasfiwlskedhpdkaysteevkvivtdlvrrlcfyrnyfshcfyldtqyfys<br>delvdttaigeklpynfhhfitnrlfryslpeitlfrwnegerkyeilrdglifccflfl<br>krgqaerflneliffkrtdeegrikrtiftkyctreshkhigieeqdflifqdiigdlnr<br>vpkvcdgvvdlskeneryiknretsnesdenkaryrllirekdkfpyylmryivdfgvlp<br>citfkqndystkegrgqfhyqdaavaqeercynfvvrngnvyysympqaqnvvriselqg<br>tisveelrnmvyasingkdvnksveqylyhlhllyekiltisgqtikegrvdvedyrpll<br>dklllrpasngeelrrelrkllpkrvcdllsnrfdcsegvsavekrlkaillrheqllls<br>qnpalhidkiksvidylylffsddekfrqqptekahrglkdeefqmyhylvgdydshpla<br>lwkeleasgrlkpemrkltsatslhglymlclkgtvewcrkqlmsigkgtakveaiadrv<br>glklydlclkeytpeqlerevklwmhgyaaaatpkpkaqaaipskltelifysflgkrem<br>sfaafirqdkkaqklwlrnfytveniktlqkrqaaadaackklynlvgevervhtndkvl<br>vlvaqryrerllnvgskcavtldnperqqkladvyevqnawlsilfddklftlthvnlsn<br>lrkaynliprkhilafkeyldnrvkqklceecrnvrrkedlctccsprysnltswlkenh<br>sessiereaatmmlldverkllsfllderrkaiieygkfipfsalvkecrladaglcgir<br>ndvlhdnvisyadaigklsayfpkeaseaveyirrtkevreqrreelmanssq |
| *Flavobacterium<br>branchiophilum* FL-15<br>(NC_016001.1)<br>>WP_014084666.1<br>(SEQ ID NO: 106) | menlnkildkeneiciskifntkgiaapitekaldnikskqkndlnkearlhyfsighsf<br>kqidtkkvfdyvlieelkdekplkfitlqkdfftkefsiklqklinsirninnhyvhnfn<br>dinlnkidsnvfhflkesfelaiiekyykvnkkypldneivlflkelfikdentallnyf<br>tnlskdealeyillftitenkiwninnehnilnieksgkyltfeamlflitiflykneanh<br>llpklydfknnkskqelftffskkftsqdidaeeghlikfrdmiqylnhyptawnndlkl<br>esenknkimttklidsiiefelnsnypsfatdiqfkkeakaflfasnlckmqtsfsnksy<br>neeirhnphikqyrdeiasaltpisfnvkedldkifvkkhvleeyfpnsigyekfleynd<br>ftekekedfglklysnpktnklieridnhklvkshgrnqdrfmdfsmrflaennyfgkda<br>ffkcykfydtqeqdeflqsnennddvkihhkgkvttyikyeehlknysywdcpfveennsm<br>svkisigseekilkiqrnlmiyflenalynenvenqgyklynnyyrelkkdveesiasld<br>liksnpdfkskykkilpkrllhnyapakqdkapenafetllkkadfreeqykkllkkaeh<br>eknkedfvkrnkgkqfklhfirkacqmmyfkekyntlkegnaafekkdpviekrknkehe<br>fghhknlnitreefndyckwmfafngndsykkylrdlfsekhffdnqeyknlfessvnle<br>afyaktkelfkkwietnkptnnenrytlenyknlilqkqvfinvyhfskylidknllnse<br>nnviqykslenveylisdfyfqskslsidqhktcgklfnklksnkledcllyeiaynyidk<br>knvhkidiqkiltskiiltindantpykisvpfnklerytemiaiknqnnlkarflidlp<br>lylsknkikkgkdsagyeiiikndleiedintinnkiindsvkftevlmelekyfilkdk<br>cilsknyidnseipslkqfskvwikeneneiinyrniachfhlpllelfdnlllnveqkf<br>ikeelqnvstindlskpqeylillfikfkhnnfylnlfnknesktikndkevkknrvlqk<br>finqvilkkk |
| *Prevotella* sp. MA2016<br>(NZ_JHUW01000010.1)<br>>WP_036929175.1<br>(SEQ ID NO: 107) | mskeckkqrqekkrrlqkanfsisltgkhvfgayfnmartnfvktinyilpiagvrgnys<br>enqinkmlhalfliqagrneelttteqkqwekklrinpeqqtkfqkllfkhfpvlgpmmad<br>vadhkaylnkkkstvqtedetfamlkgvsladcldiiclmadtltecrnfythkdpynkp<br>sqladqylhqemiakkldkvvvasrrilkdreglsvnevefltgidhlhqevlkdefgna<br>kvkdgkvmktfveyddfyfkisgkrlvngytytttkddkpvnvntmlpalsdfgllyfcvl<br>flskpyaklfidevrlfeyspfddkenmimsemlsiyrirtprlhkidshdskatlamdi<br>fgelrrcpmelynlldknagqpffhdevkhpnshtpdvskrlryddrfptlalryidete<br>lfkrirfqlqlgsfrykfydkencidgrvrvrriqkeingygrmqevadkrmdkwgdliq<br>kreersvkleheelyinldqfledtadstpyvtdrrpaynihanriglywedsqnpkqyk<br>vfdengmyipelvvtedkkapikmpaprcalsvydlpamlfyeylreqqdnefpsaeqvi<br>ieyeddyrkffkavaegklkpfkrpkefrdfikkeypklrmadipkklqlflcshglcyn<br>nkpetvyerldrltlqhleerelhiqnrlehyqkdrdmignkdnqygksfsdvrhgala<br>lylaqsmmewqptklkdkekghdkltglnynvltaylatyghpqvpeegftprtleqvli<br>nahliggsnphpfinkvlalgnmieelylhyleeellchirsriqlssnpsdkalsalp<br>fihhdrmryhertseemmalaaryttiqlpdglftpyileilqkhytensdlqnalsqdv<br>pvklnptcnaaylitlfyqtvlkdnaqpfylsdktytrnkdgekaesfsfkrayelfsvl<br>nnnkkdtfpfemiplfltsdeiqerlsaklldgdgnpvpevgekgkpatdsqgntiwkrr<br>iysevddyaekltdrdmkisfkgeweklprwkqdkiikrrdetrrqmrdellqrmpryir<br>dikdnertlrryktqdmvlfllaekmftniiseqssefnwkqmrlskvcneaflrqtlif<br>rvpvtvgettiyvegenmslknygefyrfltddrlmsllnnivetlkpnengdlvirhtd<br>lmselaaydqyrstifmliqsienliitnnavlddpdadgfwvredlpkrnnfaslleli<br>nqlnnveltdderkllvairnafshsnynidfslikdvkhlpevakgilqhlqsmlgvei<br>tk |
| *Myroides odoratimimus*<br>CCUG 10230<br>(AGEC02000017.1)<br>>EHO06562.1<br>(SEQ ID NO: 108) | mkdilttdttekqnrfyshkiadkyffggyfnlasnniyevfeevnkrnlfgklakrdng<br>nlknyiihvfkdelsisdfekrvaifasyfpiletvdkksikernrtidltlsqrirqfr<br>emlislvtavdqlrnfythyhhsdivienkvldflnssfvstalhvdkyltktdktkefl<br>ketiaaeldilieaykkkqiekknrfkankredilnaiyneafwsfindkdkdkdketv<br>vakgadayfeknhhksndpdfalnisekgivyllsffltnkemdslkanltgfkgkvdre |

TABLE 5-continued

| Cas1b | |
|---|---|
| | Cas13b orthologs |
| | sgnsikymatqriysfhtyrglkqkirtseegvketllmqmidelskvpnvvyqhlsttq
qnsfiedwneyykdyeddvetddlsrvihpvirkryedrfnyfairfldeffdfptlrfq
vhlgdyvhdrrtkqlgkvesdriikekvtvfarlkdinsakasyfhsleeqdkeeldnkw
tlfpnpsydfpkehtlqhqgeqknagkigiyvklrdtqykekaaleearkslnpkersat
kaskydiitqlleandnyksekplvftgqpiaylsmndihsmlfslltdnaelkktpeev
eaklidqigkqineilskdtdtkilkkykdndlketdtdkitrdlardkeeieklileqk
qraddynytsstkfnidksrkrkhllfnaekgkigvwlandikrfmfkeskskwkgyqht
elqklfayfdtsksdlelilsnmvmvkdypielidlvkksrtlvdflnkylearleyien
vitrvknsigtpqfktvrkecftflkksnytvvsldkqverilsmplfiergfmddkptm
legksykqhkekfadwfvhykensnyqnfydtevyeittedkrekakvtkkikqqqkndv
ftlmmvnymleevlklssndrlslnelyqtkeerivnkqvakdtqernknyiwnkvvdlq
lcdglvhidnvklkdignfrkyendsrvkefltyqsdivwsaylsnevdsnklyvierql
dnyesirskellkevqeiecsvynqvankeslkqsgnenfkqyvlqgllpigmdvremli
lstdvkfkkeeiiqlgqageveqdlysliyirnkfahnqlpikeffdfcennyrsisdne
yyaeyymeifrsikekyan |
| *Myroides odoratimimus* CCUG 3837 (AGZK01000016.1) >EKB06014.1 (SEQ ID NO: 109) | mkdilttdttekqnrfyshkiadkyffggyfnlasnniyevfeevnkrnffgklakrdng
nlknyiihvfkdelsisdfekrvaifasyfpiletvdkksikernrtidlfisqrirqfr
emlislvtavdqlrnfythyhhseivienkvldflnsslvstalhvkdkylktdktkefl
ketiaaeldilieaykkkqiekkntrfkankredilnaiyneafwsfindkdkdketvva
kgadayfeknhhksndpdfalnisekgivyllsffltnkemdslkanltgfkgkvdresg
nsikymatqriysfhtyrglkqkirtseegvketllmqmidelskvpnnvyqhlsttqqn
sfiedwneyykdyeddvetddlsrvdhpvirkryedrfnyfaiffldeffdfptlrfqvh
lgdyvhdrrtkqlgkvesdriikekvtvfarlkdinsakasyfhsleeqdkeeldnkwtl
fpnpsydfpkehtlqhqgeqknagkigiyvklrdtqykekaaleearkslnpkersatka
skydritqiieandnyksekplvftgqpiaylsmndihsmlfslltdnaelkktpeevea
klidqigkqineilskdtdtkilkkykdndlketdtdkitrdlardkeeieklileqkqr
addynytsstkfnidksrkrkhllfnaekgkigvwlandikrfmfkeskskwkgyqhtel
qklfayfdtsksdlelilsdmvmvkdypielidlyrksrtivdflnkylearlgyienvi
trvkinsigtpqatvrkecfaflkesnytvasldkqierilsmplfiergfmdskptmle
gksyqqhkedfadwfvhykensnyqnfydtevyeiitedkreqakvtkkikqqqkndvft
lmmvnymleevlklpsndrslsnelyqtkeerivnkqvakdtqernknyiwnkvvdlqlc
eglvridkvklkdignfrkyendsrvlefltyqsdivwsgylsnevdsnklyvierqldn
yesirskellkevqeiecivynqvankeslkqsgnenfkqyvlqgllprgtdvremlils
tdvkfkkeeimqlgqvreveqdlysliyirnkfahnqlpikeffdfcennyrpisdneyy
aeyymeifrsikekyas |
| *Myroides odoratimimus* CCUG 3837 (NZ_JH815535.1) >WP_006265509.1 (SEQ ID NO: 110) | mkdilttdttekqnrfyshkiadkyffggyfnlasnniyevfeevnkrnffgklakrdng
nlknyiihvfkdelsisdfekrvaifasyfpiletvdkksikernrtidlfisqrirqfr
emlislvtavdqlrnfythyhhseivienkvldflnsslvstalhvkdkylktdktkefl
ketiaaeldilieaykkkqiekkntrfkankredilnaiyneafwsfindkdkdketvva
kgadayfeknhhksndpdfalnisekgivyllsffltnkemdslkanltgfkgkvdresg
nsikymatqriysfhtyrglkqkirtseegvketllmqmidelskvpnnvyqhlsttqqn
sfiedwneyykdyeddvetddlsrvihpvirkryedrfnyfaiffldeffdfptlrfqvh
lgdyvhdrrtkqlgkvesdriikekvtvfarlkdinsakasyfhsleeqdkeeldnkwtl
fpnpsydfpkehtlqhqgeqknagkigiyvklrdtqykekaaleearkslnpkersatka
skydritqiieandnyksekplvftgqpiaylsmndihsmlfslltdnaelkktpeevea
klidqigkqineilskdtdtkilkkykdndlketdtdkitrdlardkeeieklileqkqr
addynytsstkfnidksrkrkhllfnaekgkigvwlandikrfmfkeskskwkgyqhtel
qklfayfdtsksdlelilsdmvmvkdypielidlyrksrtivdflnkylearlgyienvi
trvknsigtpqfktvrkecfaflkesnytvasldkqierilsmplfiergfmdskptmle
gksyqqhkedfadwfvhykensnyqnfydtevyeritedkreqakytkkikqqqkndvft
lmmvnymleevlklpsndrslsnelyqtkeerivnkqvakdtqernknyiwnkvvdlqlc
eglvridkvklkdignfrkyendsrvkefltyqsdivwsgylsnevdsnklyvierqldn
yesirskellkevqeiecivynqvankeslkqsgnenfkqyvlqgllprgtdvremlils
tdvkfkkeeimqlgqvreveqdlysliyirnkfahnqlpikeffdfcermyrpisdneyy
aeyymeifrsikekyas |
| *Myroides odoratimimus* CCUG 12901 (NZ_JH590834.1) >WP_006261414.1 (SEQ ID NO: 111) | mkdilttdttekqnrfyshkiadkyffggyfnlasnniyevfeevnkrnffgklakrdng
nlknyiihvfkdelsisdfekrvaifasyfpiletvdkksikernrtidlfisqrirqfr
emlislvtavdqlrnfythyhhseivienkvldflnsslvstalhvkdkylktdktkefl
ketiaaeldilieaykkkqiekkntrfkankredilnaiyneafwsfindkdkdketvva
kgadayfeknhhksndpdfalnisekgivyllsffltnkemdslkanltgfkgkvdresg
nsikymatqriysfhtyrglkqkirtseegvketllmqmidelskvpnnvyqhlsttqqn
sfiedwneyykdyeddvetddlsrvihpvirklyedrfnyfairfldeffdfptlrfqvh
lgdyvhdrrtkqlgkvesdriikekvtvfarlkdinsakanyfhsleeqdkeeldnkwtl
fpnpsydfpkehtlqhqgeqknagkigiyvklrdtqykekaaleearkslnpkersatka
skydritqiieandnyksekplvftgqpiaylsmndihsmlfslltdnaelkktpeevea
klidqigkqineilskdtdtkilkkykdndlketdtdkitrdlardkeeieklileqkqr
addynytsstkfnidksrkrkhllfnaekgkigvwlandikrfmteefkskwkgyqhtel
qklfayydtsksdldlilsdmvmvkdypielialvkksrtivdflnkylearlgymenvi
trvlnsigtpqfktyrkecftflkksnytvvsldkqverilsmplfiergfmddkptmle
gksyqqhkekfadwfvhykensnyqnfydtevyeittedkrekakytkkikqqqkndvft |

TABLE 5-continued

| Cas1b | |
|---|---|
| Cas13b orthologs | |
| | lmmvnymleevlklssndrlslnelyqtkeerivnkqvakdtqernknyiwnkvvdlqlc
eglvridkvklkdignfrkyendsrvkefltyqsdivwsaylsnevdsnklyvierqldn
yesirskellkevqeiecsvynqvankeslkqsgnenfkqyvlqglvpigmdvremlils
tdvkfikeeiiqlgqageveqdlysliyirnkfahnqlpikeffdfcennyrsisdneyy
aeyymeifrsikekyts |
| Myroides odoratimimus
CCUG 12901
(AGED01000033.1)
>EHO08761.1
(SEQ ID NO: 112) | mkdilttdttekqnrfyshkiadkyffggyfnlasnniyevfeevnkrntfgklakrdng
nlknyiihvfkdelsisdfekrvaifasyfpiletvdkksikernrtidltlsqrirqfr
emlislvtavdqlrnfythyhhseivienkvldflnssfvstalhvkdkylktdktkefl
ketiaaeldilieaykkkqiekkntrfkankredilnaiyneafwsfindkdkdketvva
kgadayfeknhhksndpdfalnisekgivyllsfilinkemdslkanligfkgkydresg
nsikymatqriysfhtyrglkqkirtseegvketllmqmidelskvpnvvyqhlsttqqn
sfiedwneyykdyeddvetddlsrvihpvirkryedrfnyfairfldeffdfptlrfqvh
lgdyvhdrrtkqlgkvesdriikekvtvfarlkdinsakanyfhsleeqdkeeldnkwtl
fpnpsydfpkehtlqhqgeqknagkigiyvklrdtqykekaaleearkslnpkersatka
skydiitqiieandnyksekplvftgqpiaylsmndihsmlfsllidnaelkktpeevea
klidqigkqineilskdtdtkilkkykdndlketdtdkitrdlardkeeiekliieqkqr
addynytssstkfnidksrkrkhllfnaekgkigvwlandikrfmteefkskwkgyqhtel
qklfayydtsksdldlilsdmvmvkdypielialvkksrtivdflnkylearlgymenvi
trvknsigtpqfktvrkecftflkksnytvvsldkqverilsmplfiergfmddkptmle
gksyqqhkekfadwfvhykensnyqnfydtevyeittedkrekakytkkikqqqkndvft
lmmvnymleevlklssndrlslnelyqtkeerivnkqvakdtqernknyiwnkvvdlqlc
eglvridkvklkdignfrkyendsrvkefltyqsdivwsaylsnevdsnklyvierqldn
yesirskellkevqeiecsvynqvankeslkqsgnenfkqyvlqglvpigmdvremlils
tdvkfikeeiiqlgqageveqdlysliyirnkfahnqlpikeffdfcennyrsisdneyy
aeyymeifrsikekyts |
| Myroides odoratimimus
(NZ_CP013690.1)
>WP_058700060.1
(SEQ ID NO: 113) | mkdilttdttekqnrfyshkiadkyffggyfnlasnniyevfeevnkrntfgklakrdng
nlknyiihvfkdelsisdfekrvaifasyfpiletvdkksikernrtidltlsqrirqfr
emlislvtavdqlrnfythyhhsdivienkvldflnssfvstalhvkdkylktdktkefl
ketiaaeldilieaykkkqiekkntrfkankredilnaiyneafwsfindkdkdketv
vakgadayfeknhhksndpdfalnisekgivyllsffitnkemdslkanitgfkgkvdre
sgnsikymatqriysfhtyrglkqkirtseegvketllmqmidelskvpnvvyqhlsttq
qnsfiedwneyykdyeddvetddlsrvthpvirkryedrfnyfairfldeffdfptlrfq
vhlgdyvhdrrtkqlgkvesdriikekvtvfarlkdinsakasyfhsleeqdkeeldnkw
tlfpnpsydfpkehtlqhqgeqknagkigiyvklrdtqykekaaleearkslnpkersat
kaskydiitqiieandnyksekplvftgqpiaylsmndihsmlfsllidnaelkktpeev
eaklidqigkqineilskdtdtkilkkykdndlketdtdkitrdlardkeeiekliileqk
qraddynytssstkfnidksrkrkhllfnaekgkigvwlandikrfmfkeskskwkgyqhi
elqklfayfdtsksdlelilsnmvmvkdypielidlykksrtivdflnkylearleyien
vitrvknsigtpqfktvrkecftflkksnytvvsldkqverilsmplfiergfmddkptm
legksykqhkeldadwfvhykensnyqnfydtevyeittedkrekakytkkikqqqkndv
ftlmmvnymleevlklssndrlslnelyqtkeerivnkqvakdtqernknyiwnkvvdlq
lcdglvhidnvklkdignfrkyendsrvkefltyqsdivwsaylsnevdsnklyvierql
dnyesirskellkevqeiecsvynqvankeslkqsgnenfkqyvlqgllpigmdvremli
lstdvkfkkeeiiqlgqageveqdlysliyirnkfahnqlpikeffdfcennyrsisdne
yyaeyymeifrsikekyan |
| Bergeyella zoohelcum
ATCC 43767
(AGYA01000037.1)
>EKB54193.1
(SEQ ID NO: 114) | menktsignniyynpfkpqdksyfagyfnaamentdsvfrelgkrlkgkeytsenffdai
fkenislveyeryvkllsdyfpmarlldkkevpikerkenfkknfkgiikavrdlrnfyt
hkehgeveitdeifgvldemlkstvltvkkkkvktdktkeilkksiekqldilcqkkley
lrdtarkieekrrnqrergekelvapfkysdkrddliaaiyndafdvyidkkkdslkess
kakyntksdpqqeegdlkipiskngvvfllslfltkqeihafkskiagfkatvideatvs
eatvshgknsicfmatheifshlaykklkrkvrtaeinygeaenaeqlsvyaketlmmqm
ldelskvpdvvyqnlsedvqktfiedwneylkenngdygtmeeeqvihpvirklyedkfn
yfairfldefaqfptlrfqvhlgnylhdsrpkenlisdrrikekitvfgrlselehkkal
fikntetnedrehyweifpnpnydfpkenisvndkdfpiagsildrekqpvagkigikvk
llnqqyvsevdkavkahqlkqrkaskpsiqniieeivpinesnpkeaivfggqptaylsm
ndihsilyeffdkwekkkeklekkgekelrkeigkelekkivgkiqaqiqqiidkdtnak
ilkpyqdgnstaidkeklikdlkqeqnilqklkdeqtvrekeyndfiayqdknreinkvr
drnhkqylkdnlkrkypeaparkevlyyrekgkvavwlandikrfmptdfknewkgeqhs
llqkslayyeqckeelknllpekvfqhlpfklggyfqqkylyqfytcyldkrleyisglv
qqaenfksenkvfkkvenecfkflkkqnythkeldarvqsilgypiflergfmdekptii
kgktfkgnealfadwfryykeyqnfqtfydtenyplvelekkqadrkrktkiyqqkkndv
ftllmakhifsvfkqdsidqfsledlyqsreerlgnqerarqtgerntnyiwnktvdlk
lcdgkitvenvklknvgdfikyeydqrvqaflkyeeniewqaflikeskeeenypyvver
eiegyekvrreellkevhlieeyilekvkdkeilkkgdnqnfkyyilngllkqlknedve
sykvfnlntepedvninqlkqeatdleqkafvltyirnkfahnqlpkkefwdycqekygk
iekektyaeyfaevfkkekealik |
| Capnocytophaga
cynodegmi
(NZ_CDOD01000002.1)
>WP_041989581.1
(SEQ ID NO: 115) | menktslgnniyynpfkpqdksyfagylnaamenidsvfrelgkrlkgkeytsenffdai
fkenislveyelyvkllsdyfpmarlldkkevpikerkenfkknfrgiikavrdlrnfyt
hkehgeveitdeifgvldemlkstvltvkkkkiktdktkeilkksiekqldilcqkkley
lkdtarkieekrrnqrergekklvprfeysdrrddliaaiyndafdvyidkkkdslkess
ktkyntesypqqeegdlkipiskngvvfllslfskqevhafkskiagfkatvideatvs
hrknsicfmatheifshlaykklkrkvrtaeinyseaenaeqlsiyaketlmmqmldels |

TABLE 5-continued

| Cas1b | |
|---|---|
| Cas13b orthologs | |
| | kvpdvvyqnlsedvqktfiedwneylkenngdygtmeeeqvihpvirkryedkinyfair
fldefaqfptlrfqvhlgnylhdsrpkehlisdrrikekitvfgrlselehkkalfiknt
etnedrkhywevfpnpnydfpkenisvndkdfpiagsildrekqptagkigikvnllnqk
yisevdkavkahqlkqrnnkpsigniieeivpingsnpkeiivfggqptaylsmndihsi
lyeffdkwekkkeklekkgekelrkeigkeleekivgkiqtqiqqiidkdinakilkpyq
dddstaidkeklikdlkqeqkilqklkneqtarekeyqeciayqeesrkikrsdksrqky
lrnqlkrkypevptrkeilyyqekgkvavwlandikrfmptdfknewkgeqhsllqksla
yyeqckeelknllpqqkvfkhlpfelgghfqqkylyqfytryldkrlehisglvqqaenf
knenkvfkkvenecfkflkkqnythkgldaqaqsvlgypiflergfmdekptiikgklfk
gneslftdwfryykeyqnfqtfydtenyplvelekkqadrkretkiyqqkkndvftllma
khifksvfkqdsidrfsledlyqsreerlenqekakqtgerntnyiwnktvdlnlcdgkv
tvenvklknvgnfikyeydqrvqtflkyeenikwqaflikeskeeenypyiverei eqye
kvrreellkevhlieeyilekvkdkeilkkgdnqnfkyyilngllkqlknedvesykvfn
lntkpedvninqlkqeatdleqkafvltyirnkfahnqlpkkefwdycqekygkiekekt
yaeyfaevfkrekealmk |
| Bergeyella zoohelcum
ATCC 43767
(NZ_JH932293.1)
>WP_002664492.1
(SEQ ID NO: 116) | menktslgnniyynpfkpqdksyfagyfnaamentdsvfrelgkrlkgkeytsenffdai
fkenislveyelyvkllsdyfpmarlldkkevpikerkenfkknfkgiikavrdlrnfyt
hkehgeveitdeifgvldemlkstvltvkkkkvktdktkeilksiekqldilcqkkley
lrdtarkieekrrnqrergekelvapfkysdkrddliaaiyndafdvyidkkkdslkess
kakyntksdpqqeegdlkipiskngvvfllslfltkqeihafkskiagfkatvideatvs
eatvshgknsicfmatheifshlaykklrkvrtaeinygeaenaeqlsvyaketlmmqm
ldelsk-vpdwyqnlsedvqktfiedwneylkenngdygtmeeeqvihpvirklyedkfn
yfairfldefaqfptlrfqvhlgnylhdsrpkenlisdrrikekitvfgrlselehkkal
fikntetnedrehyweifpnpnydfpkenisvndkdfpiagsildrekqpvagkigikvk
llnqqyvsevdkavkahqlkqrkaskpsiqniieeivpinesnpkeaivfggqptaylsm
ndihsilyeffdkwekkkeklekkgekelrkeigkelekkivgkiqaqiqqiidkdtnak
ilkpyqdgnstaidkeklikdlkqeqnilqklkdeqtvrekeyndfiayqdknreinkvr
drnhkqylkdnlkrkypeaparkevlyyrekgkvavwlandikffmptdfknewkgeqhs
llqkslayyeqckeelknllpekvfqhlpfklggyfqqkylyqfytcyldkrleyisglv
qqaenfksenkvfkkvenecfkflkkqnythkeldarvqsilgypiflergfmdekptii
kgktfkgnealfadwfryykeyqnfqtfydtenyplvelekkqadrkrktkiyqqkkndv
ftllmakhifksvfkqdsidqfsledlyqsreerlgnqerarqtgerntnyiwnktvdlk
lcdgkitvemllknvgclfikyeydqrvqaflkyeeniewqaflikeskeeenypriver
eiegyekvn-eellkevhlieeyilekvkdkeilkkgdnqnfkyyilngllkqlknedve
sykvfnlntepedvninqlkqeatdleqkafvltyirnkfahnqlpkkefwdycqekygk
iekektyaeyfaevfkkekealik |
| Flavobacterium sp. 316
(NZ_JYGZ01000003.1)
>WP_045968377.1
(SEQ ID NO: 117) | mdnnitvektelglgitynhdkvedkhyfggffnlaqnnidlvaqefkkrlliqgkdsin
ifanyfsdqcsitnlergikilaeyfpvvsyidldeknksksirehlillletinnlrny
ythyyhkkiiidgslfplldtillkyvleikkkklkedktkqllkkglekemtilfnlmk
aeqkekkikgwnidenikgavlnrafshllyndelsdyrkskyntedetlkdtltesgil
fllssfflnkkeqeqlkanikgykgkiasipdeeitlknnslrnmathwtyshltykglkh
riktdheketllvnmvdylskvpheiyqnlseqnkslfledineymrdneenhdsseasr
vihpvirkryenkfayfairfldefaefptltfmvnvngnyihdnrkkdiggtslitnrti
kqqinvlgnlteihkkkndyfekeenkektlewelfpnpsyhfqkenipifidlekseket
ndlakeyakekkkifgssrkkqqntakknretiinlvfdkyktsdrktvtfeqptallsf
nelnsflyaflvenktgkelekiiiekianqyqilkncssstvdktndnipksikkivntt
tdsfyfegkkidieklekditieiektneklketikeneesaqnykrnerntqkrklyrky
vfftneigieatwitndilrfldnkenwkgqyhselqkfisqydnykkealgllesewnl
esdaffgqnlkrmfqsnstfetfykkyldnrkntletylsaienlktmtdvrpkvlkkkw
telfiffddkkiyllstietkinelitkpinlsrgifeekptfingknpnkennqhlfanw
fiyakkqtilqdfynlpleqpkaitnlkkhkyklersinnlkiediyikqmvdflyqklf
eqsfigslqdlytskekreiekgkakneqtpdesfiwkkqveinthngriiaktkikdig
kfknlltdnkiahlisyddriwdfslnndgditkklysintelesyetirrekllkqiqq
feqfllegeteysaerkhpekfekdcnpnfkkyiiegvinkiipnheieeieilkskedv
fkinfsdililnndnikkgyllimirnkfahnqlidknlfnfslqlysknenenfseyln
kvcqniiqefkeklk |
| Psychroflexus torquis
ATCC 700755
(NC_018721.1)
>WP_015024765.1
(SEQ ID NO: 118) | mesiiglglsfnpyktadkhyfgsflnlvennlnavfaefkerisykakdenissliekh
fidnmsivdyekkisilngylpiidflddelennlntrvknfkknfiillaeaieklrdyy
thfyhdpilfednkepllelldevllktildvkkkylktdktkeilkdslreemdllvir
ktdelrekkktnkiqhtdssqiknsifndafqgllyedkgnnkktkqvshraktrlnpkd
ihkqeerdfeiplststglvflmslflskkeiedfksnikgfkgkvvkdenhnslkymath
rvysilafkglkyriktdtfsketlmmqmidelskvpdcvyqnlsetkqkdfiedwneyf
kdneentenlensrvvhpvirkryedkfnyfairfldefanfktlkfqvfmgyyihdqrt
ktigttnittertykekinvfgklskmdnlkkhffsqlsddentdweffpnpsynfltqa
dnspannipiylelknqqiiekekdaikaevnqtqnrnpnkpskrdllnkilktyedfhqg
dptailslneipallhlflvkpnnktgqqieniirikiekqfkainhpsknnkgipkslf
adtnvrvnaiklkkdleaeldmlnkkhiafkenqkassnydkllkehqftpknkrpelrk
yvfyksekgeeatwlandikrfmpkdfktkwkgcqhselqrklafydrhtkqdikellsg
cefdhslldinayfqkdnfedffskylenrietlegvlkklhdfkneptplkgvflmcfk
flkrqnyvtespeiikkrilakptflprgvfderptmkkgknplkdknefaewfveylen
kdyqkfynaeeynm-dadfkknavikkqklkdfytlqmvnyllkevfgkdemnlqlself
qtrqerlklqggiakkqmnketgdssentrnqtyiwnkdvpvsffngkvtidkvklknigk
ykryerdervktfigyevdekwmmylphnwkdlysvkpinvidlqiqeyeeirshellke |

TABLE 5-continued

Cas1b

Cas13b orthologs

|  |  |
|---|---|
|  | iqnleqyiydhttdknillqdgnpnfkmyvlngllligikqvnipdfivlkqntnfdkidf<br>tgiascselekktiiliairnkfahnqlpnkmiydlaneflkieknetyanyylkvlkkm<br>isdla |
| *Flavobacterium columnare* ATCC 49512<br>(NC_016510.2)<br>>WP_014165541.1<br>(SEQ ID NO: 119) | mssknesynkqktfnhykqedkyffggflnnaddnlrqvgkefktrinfnhnnnelasvf<br>kdyfnkeksvakrehalnllsnyfpvleriqkhtnhnfeqtreifellldtikkftdyyt<br>hhyhkpitinpkiydflddtlldvlitikkkkvkndtsrellkeklrpeltqlknqkree<br>likkgkklleenlenavfnhclrpfleenktddkqnktvslrkyrkskpneetsitltqs<br>glvflmsfahrkefqvftsglegfkalcvntikeeeislnknnivymithwsysyynfkg<br>lkhriktdqgvstleqnntthsltntntkealltqivdylskvpneiyetlsekqqkefe<br>edineymrenpenedsffssivshkvirkryenkfnyfamrfldeyaelptlrfmvnfgd<br>yikdrqkkilesiqfdseriikkeihlfeklslvteykknvylketsnidlsffpIfpnp<br>syvmannnipfyidsrsnnldeylnqkkkaqsqnkkrnllfekynkeqskdaiiamlqke<br>igvkdlqqrstigllscnelpsmlyevivkdikgaelenkiaqkireqyqsirdftldsp<br>qkdnipttliktintdssvtfenqpidiprlknaiqkeltltqekllnykeheievdnyn<br>rnkntykaknqpknkvddkklqrkyvfyrneirqeanwlasdlihfmknkslwkgymhne<br>lqsflaffedkkndcialletvfnlkedciltkglknlflkhgnfidfykeylklkedfl<br>ntestflengligIppkilkkelskilkyifivfqkrqflikeleeekknnlyadainlsr<br>gifdekptmipfklqmpdefaswfvasyqynnyqsfyeltpdiverdkkkkyknfraink<br>vkiqdyylklmvdtlyqdlfnqpldkslsdfyvskaerekikadakayqkrndsslwnkv<br>ihlslqnnritanpklkdigkykralqdekiatllltyddrtwtyalqkpekenendykel<br>hytalnmelqeyekvrskellkqvqelekqileeytdflstqihpadferegnpnfkkyl<br>ahsileneddldklpekveamreldetitnpiikkaivliiirnkmahnqyppkfiydla<br>nrfvpkkeeeyfatyfnrvfetitkelwenkekkdktqv |
| *Flavobacterium columnare*<br>(NZ_CP013992.1)<br>>WP_060381855.1<br>(SEQ ID NO: 120) | mssknesynkqktfnhykqedkyffggflnnaddnlrqvgkefktrinfnhnnnelasvf<br>kdyfnkeksvakrehalnllsnyfpvleriqkhtnhnfeqtreifellldtikkftdyyt<br>hhyhkpitinpkyydflddfildvlitikkkkvkndtsrellkekirpeltqlknqkree<br>likkgkklleenlenavfnhclrpfleenktddkqnktvslrkyrkskpneetsitltqs<br>glvflisfflhrkefqvftsglegfkavntikeeeislnknnivymithwsysyynfkg<br>lkhriktdqgvstleqnntthsltntntkealltqivdylskvpneiyetlsekqqkefe<br>edineymrenpenedstfssivshkvirklyenkfnyfamrfldeyaelptlrfmvnfgd<br>yikdrqkkilesiqfdseriikkeihlfeklglvteykknvylketsnidlsffpIfpsp<br>syvmanrmipfyidsrsnnldeylnqkkkaqsqnrkrnllfekynkeqskdaiiamlqke<br>igvkdlqqrstigllscnelpsmlyevivkdikgaelenkiaqkireqyqsirdftldsp<br>qkdnipttltktistdtsvtfenqpidiprlknalqkeltltqekllnvlqheievdnyn<br>rnkntykfknqpkdkvddnklqrkyvfyrneigqeanwlasdlihfmknkslwkgymhne<br>lqsflaffedkkndcialletvfnlkedciltkdlknlflkhgnfidfykeylklkedfl<br>ntestflengfiglppkilkkelskrinyifivfqkrqfiikeleeekknnlyadainlsr<br>gifdekptmipfklqmpdefaswfvasyqynnyqsfyeltpdkiendkkkkyknfraink<br>vkiqdyylklmvdtlyqdlfnqpldkslsdfyvsktdrekikadakayqkrndsflwnkv<br>ihlslqnnritanpklkdigkykralqdekiatllltyddrtwtyalqkpekenendykel<br>hytalnmelqeyekvrskkllkqvqelekqildkfydfsnnathpedleiedkkgkrhpn<br>fklyitkallkneseiinlenidieilikyydynteklkekiknmdedekakivntkeny<br>nkitnvlikkalvliiirnkmahnqyppkfiydlatrfvpkkeeeyfacyfnrvfetitt<br>elwenkkkakeiv |
| *Flavobacterium columnare*<br>(NZ_CP015107.1)<br>>WP_063744070.1<br>(SEQ ID NO: 121) | mssknesynkqktfnhykqedkyffggflnnaddnlrqvgkefktrinfnhnnnelasvf<br>kdyfnkeksvakrehalnllsnyfpvleriqkhtnhnfeqtreifellldtilddrdyyt<br>hhyhkpitinpklddtlldvlitikkkkvkndtsrellkeklrpeltqlknqkree<br>likkgkklleenlenavfnhclrpfleenktddkqnktvslrkyrkskpneetsitltqs<br>glvflmsfflhrkefqvftsglegfkakvntikeekislnknnivymithwsysyynfkg<br>lkhriktdqgvstleqnntthsltntntkealltqivdylskvpneiyetlsekqqkefe<br>edineymrenpenedstfssivshkvirklyenkfnyfamrfldeyaelptlrfmvnfgd<br>yikdrqkkilesiqfdseriikkeihlfeklglvteykknvylketsnidlsrfplfpsp<br>syvmannnipfyidsrsnnldeylnqkkkaqsqnrkrnllfekynkeqskdaiiamlqke<br>igvkdlqqrstigllscnelpsmlyevivkdikgaelenkiaqkireqyqsirdftlnsp<br>qkdnipttliktistdtsvtfenqpidiprlknaiqkelaltqekllnvlqheievimyn<br>rnkntykfknqpkdkvddnklqrkyvfyrneigqeanwlasdlihfmknkslwkgymhne<br>lqsflaffedkkndcialletvfnlkedciltkdlknlflkhgnfidfykeylklkedfl<br>ntestflengfiglppkilkkelskrinyifivfqkrqfiikeleeekknnlyadainlsr<br>gifdekptmipfklqmpdefaswfvasyqynnyqsfyeltpdkiendkkkkyknfraink<br>vkiqdyylklmvdtlyqdlfnqpldkslsdfyvsktdrekikadakayqkrndsflwnkv<br>ihlslqnnritanpklkdigkykralqdekiatllltyddrtwtyalqkpekenendykel<br>hytalnmelqeyekvrskkllkqvqelekqildkfydfsnnathpedleiedkkgkrhpn<br>fklyitkallkneseiinlenidieilikyydynteklkekiknmdedekakivntkeny<br>nkitnvlikkalvliiirnkmahnqyppkfiydlatrfvpkkeeeyfacyfnrvfetitt<br>elwenkkkakeiv |
| *Flavobacterium columnare*<br>(NZ_CP016277.1)<br>>WP_065213424.1<br>(SEQ ID NO: 122) | mssknesynkqktfnhykqedkyffggflnnaddnlrqvgkefktrinfnhnnnelasvf<br>kdyfnkeksvakrehalnllsnyfpvleriqkhtnhnfeqtreifellldtilddrdyyt<br>hhyhkpitinpkiydflddtlldvlitikkkkvkndtsrellkeklrpeltqlknqkree<br>likkgkklleenlenavfnhclipfleenktddkqnktvslrkyrkskpneetsitltqs<br>glvflmsfflhrkefqvftsglerfkakvntikeeeislnknnivymithwsysyynfkg<br>lkhriktdqgvstleqnntthsltntntkealltqivdylskvpneiyetlsekqqkefe<br>edineymrenpenedsffssivshkvirkryenkfnyfamrfldeyaelptlrfmvnfgd |

TABLE 5-continued

Cas1b

Cas13b orthologs

| | |
|---|---|
| | yikdrqkkilesiqfdseriikkeihlfeklslvteykknvylketsnidlsrfplfpnp<br>syvmanrmipfyidsrsnnldeylnqkkkaqsqnkkrnllfekynkeqskdaiiamlqke<br>igvkdlqqrstigllscnelpsmlyevivkdikgaelenkiaqkireqyqsirdftldsp<br>qkdnipttliktintdssvtfenqpidiprlknalqkeltltqekllnvkeheievdnyn<br>rnkntykfknqpknkvddkklqrkyvfyrneirqeanwlasdlihfmknkslwkgymhne<br>lqsflaffedkkndciallletvfnlkedciltkglknlflkhgnfidfykeylklkedfl<br>stestflengfiglppkilkkelskrlkyifivfqkrqfiikeleekknnlyadainlsr<br>gifdekptmipfklqmpdefaswfvasyqynnyqsfyeltpdiverdkkkyknfraink<br>vkiqdyylklmvdtlyqdlfnqpldkslsdfyvskaerekikadakayqklndsslwnkv<br>ihlslqnnritanpklkdigkykralqdekiatlltydartwtyalqkpekenendykel<br>hytalnmelqeyekvrskellkqvqelekkildkfydfsnnashpedleiedkkgkrhpn<br>fklyitkallkneseiinlenidieillkyydynteelkekiknmdedekakiintkeny<br>nkitnvlikkalvliiirnkmahnqyppkfiydlanrfvpkkeeeyfatyfnryfetitk<br>elwenkekkdktqv |
| *Chryseobacterium* sp.<br>YR477<br>(NZ_KN549099.1)<br>>WP_047431796.1<br>(SEQ ID NO: 123) | metqfighgiaydhskiqdkhffggflnlaennikavlkafsekfnvgnvdvkqfadvsl<br>kdnlpdndfqkryvsflkmyfpyydfinipmirakfrsdltllfksvdqlmfythyyhkp<br>ldfdaslfillddifartakevrdqkmkddlftrqllskslseelqkgyelqlerlkelm<br>lgkkvnihdqlgikngvlnnafnhlliykdgesfktkltyssaltsfesaengieisqsgl<br>lfllsmflkrkeiedlknrnkgfkakvvidedgkvnglkfmathwvfsylcfkglkskls<br>tefheetlliqiidelskvpdelycafdketrdkfiedineyvkeghqdfsledakvihp<br>virkryenkfnyfairfldefvkfpslrfqvhvgnyvhdrriknidgttfeterwvkdri<br>kvfgrlseissykaqylssysdkhdetgweifpnpsyvfinrmipihisvdtsfkkeiad<br>fkklrraqvpdelkirgaekkrkfeitqmigsksvinqeepiallslneipallyeilin<br>gkepaeieriikdklnerqdviknynpenwlpasqisrrlrsnkgeriintdkllqlvtk<br>ellvteqklkiisdnrealkqkkegkyirkfiftnselgreaiwladdikrfmpadvrke<br>wkgyqhsqlqqslafynsrpkealailesswnlkdekiiwnewilksftqnkffdafyne<br>ylkgrkkyfaffsehivqytsnaknlqkfikqqmpkdlfekrhyliedlqteknkilskp<br>fifprgifdkkplfikgvkvedspesfanwyqygyqkdhqfqkfydwkrdysdvflehlg<br>kpfinngdrrtlgmeelkeriiikqdlkikkikiqdlflrliaenlfqkvfkysaklpls<br>dfyltqeermekenmaalqnvreegdkspniikdnfiwskmipykkgqiienavklkdig<br>klnvlsldkvqtllsyddakpwskialenefsigensyevin-eklfkeiqqfeseilf<br>rsgwdginhpaqlednmpkfkmyivngilrksaglysqgediwfeynaclfnnldadvle<br>tkselvqlaflvtairnkfahnqlpakefyfyirakygfadepsvalvylnftkyainef<br>kkvmi |
| *Riemerella anatipestifer*<br>ATCC 11845 = DSM<br>15868 (NC_014738.1)<br>>WP_004919755.1<br>(SEQ ID NO: 124) | mekpllpnvytlkhkffwgaflniarhnafitichineqlglktpsnddkivdvvcetwn<br>nilnndhdlllkksqltelilkhfpfltamcyhppkkegkkkghqkeqqkekeseaqsqae<br>alnpskliealeilvnqlhslrnyyshykhkkpdaekdifkhlykafdaslrmykedyka<br>hftvnitrdfahlnrkgknkqdnpdfnryffekdgfftesgllfftnlfldkrdaywmlk<br>kvsgfkashkqrekmttevfcrsrillpklrlesrydhnqmlldmlselsrcpkllyekl<br>seenkkhfqveadgfldeieeeqnpfkdtlirhqdifpyfalryldlnesfksiifqvdl<br>gtyhyciydkkigdeqekrhltrtllsfgrlqdfteim-pqewkaltkdldyketsnqpf<br>iskttphyhitdnkigfrlgtskelypsleikdganriakypynsgfrahafisvhellp<br>lmfyqhltgksedllketvrhiqriykdfeeerintiedlekanqgrlplgafpkqmlgl<br>lqnkqpdlsekakikiekliaetkllshrlntklkssphklgkrreklikhgvladwlykd<br>fmrfqpvaydaqnqpiksskanstefwfirralalyggeknrlegyfkqtnligntnphp<br>flnlcfnwkacmlvdfyqqyleqrekfleaiknqpwepyqyclllkipkenrknlvkgwe<br>qggislprglfteairetlsedlmlskpirkeikkhgrvgfisraitlyfkekyqdkhqs<br>fynlsykleakaplllkreehyeywqqnkpqsptesqrlelhtsdrwkdyllykrwqhlek<br>klrlyrnqdvmlwlmtleltknhfkelnlnyhqlklenlavnvqeadaklnpinqtlpmv<br>lpvkvypatafgevqyhktpirtvyireehtkalkmgnfkalvkdrrlnglfsfikeend<br>tqkhpisqlrlreleiyqslrvdafketlsleekllnkhtslsslenefralleewkke<br>yaassmvtdehiafiasvrnafchnqypfykealhapiplftvaqptteekdglgiaeal<br>lkvlreyceivksqi |
| *Riemerella anatipestifer*<br>RA-CH-2<br>(NC_020125.1)<br>>WP_015345620.1<br>(SEQ ID NO: 125)<br>COMMENT<br>REFSEQ: This record<br>represents a single, non-<br>redundant, protein<br>sequence which may be<br>annotated on many<br>different RefSeq<br>genomes from the same,<br>or different, species<br>(suppressed in databse) | mffsfhnaqrvifkhlykafdaslrmvkedykahftvnltrdfahlnrkgknkqdnpdfn<br>ryrfekdgfftesgllfftnlfldkrdaywmlkkvsgfkashkqrekmttevfcrsrill<br>pklrlesrydhnqmlldmlselsrcpkllyeklseenkkhfqveadgfldeieeeqnpfk<br>dtlirhqdrfpyfalryldlnesfksirfqvdlgtyhyciydkkigdeqekrhltrtlls<br>fgrlqdfteinrpqewkaltkdldyketsnqpfiskttphyhitdnkigfrlgtskelyp<br>sleikdganriakypynsgfvahafisvhellplmfyqhltgksedllketvrhiqriyk<br>dfeeerintiedlekanqgrlplgafpkqmlgllqnkqpdlsekakikiekliaetklls<br>hrlntklkssphklgkrreklikhgvladwlvkdfmrfqpvaydaqnqpiksskanstefw<br>firralalyggeknrlegyfkqtnligntnphpflnkfnwkacrnlvdfyqqylegrekf<br>leaikhqpwepyqyclllkvpkenrknlvkgweqggislprglfteairetlskdltlsk<br>pirkeikkhgrygfisraitlyfkekyqdkhqsfynlsykleakaplllkeehyeywqqn<br>kpqsptesqrlelhtsdrwkdyllykrwqhlekklrlyrnqdimlwlmtleltknhfkel<br>nlnyhqlklenlavnvqeadaklnpinqtlpmvlpvkvypttafgevqyhetpirtvyir<br>eeqtkalkmgnfkalvkdrrlnglfsfikeendtqkhpisqlrlreleiyqslrvdafk<br>etlsleekllnkhaslsslenefrtlleewkkkyaassmvtdkhiafiasvrnafchnqy<br>pfyketlhapillftvaqptteekdglgiaeaallkvlreyceivksqi |
| *Riemerella anatipestifer*<br>(NZ_CP007504.1)<br>>WP_049354263.1 | mffsfhnaqrvifkhlykafdaslrmykedykahftvnitrdfahlnrkgknkqdnpdfn<br>ryrfekdgfftesgllfftnlfldkrdaywmlkkvsgfkashkqrekmttevfcrsrill<br>pklrlesrydhnqmlldmlselsrcpkllyeklseenkkhfqveadgfldeieeeqnpfk |

TABLE 5-continued

| Cas1b | |
|---|---|
| Cas13b orthologs | |
| (SEQ ID NO: 126) | dtlirhqdrfpyfalryldlnesfksirfqvdlgtyhyciydkkigdeqekrhltrtlls fgrlqdfteinrpqewkaltkdldyketsnqpfiskttphyhitdnkigfrlgtskelyp sleikdganriakypynsgfvahafisvhellplmfyqhltgksedllketvrhiqriyk dfeeerintiedlekanqgrlplgafpkqmlgllqnkqpdlsekakikiekliaetklls hrlntklksspklgkrrekliktgvladwlykdfmrfqpvaydaqnqpiksskanstefw firrlalyggeknrlegyfkqtnligntnphpflnkfnwkacrnlvdfyqqyleqrekl leaiknqpwepyqyclllkipkenrknlvkgweqggislprglfteairetlsedlmlsk pirkeikkhgrvgfisraitlyfkekyqdkhqsfynlsykleakapllkreehyeywqqn kpqsptesqrlelhtsdrwkdyllykrwqhlekklrlyrnqdvmlwlmtleltknhfkel nlnyhqlklenlavnvqeadaldnpinqtlpmvlpvkvypatafgevqyhktpirtvyir eehtkalkmgnfkalvkdrrlnglfsfikeendtqkhpisqlrlrreleiyqslrvdafk etlsleekllnkhtslsslenefralleewkkeyaassmvtdehiafiasvrnafchnqy pfykealhapiplftvaqptteekdglgiaeallkvlreyceivksqi |
| Riemerella anatipestifer (NZ_LUDU01000012.1) >WP_061710138.1 (SEQ ID NO: 127) | mffsfhnaqrvifkhlykafdaslrmvkedykahftvnltrdfahlnrkgknkqdnpdfn ryrfekdgfftesgllfftnlfldkrdaywmlkkvsgfkashkqsekmttevfcrsrill pklrlesrydhnqmlldmlselsrcpkllyeklsekdkkcfqveadgfldeieeeqnpfk dtlirhqdrfpyfalryldlnesfksirfqvdlgtyhyciydkkigyeqekrhltrftln fgrlqdfteinrpqewkaltkdldynetsnqpfiskttphyhitdnkigfrlrtskelyp slevkdganriakypynsdfvahafisisvhellplmfyqhltgksedllketvrhiqri ykdfeeerintiedlekanqgrlplgafpkqmlgllqnkqpdlsekakikiekliaetkl lshrlntklksspklgkrrekliktgvladwlvkdfmrfqpvvydaqnqpiksskanste srlirralalyggeknrlegyfkqtnligntnphpflnkfnwkacrnlvdfyqqyleqre kfleaikhqpwepyqyclllkvpkenrknlvkgweqggislprglfteairetlskdltl skpirkeikkhgrvgfisraitlyfkekyqdkhqsfynlsykleakapllkreehyeywq qnkpqsptesqrlelhtsdrwkdyllykrwqhlekklrlyrnqdimlwlmtleltknhfk elnlnyhqlklenlavnvqeadaklnpinqtlpmvlpvkvypttafgevqyhetpirtvy ireeqtkalkmgnfkalvkdrhlnglfsfikeendtqkhpisqlrlrreleiyqslrvda fketlsleekllnkhaslsslenefrtlleewkkkyaassmvtdkhiafiasvrnafchn qypfyketlhapillftvaqptteekdglgiaeallrvlreyceivksqi |
| Riemerella anatipestifer (NZ_LUDI01000010.1) >WP_064970887.1 (SEQ ID NO: 128) | mekplppnvytlkhkffwgaflniarhnafitichineqlglttppnddkiadvvcgtwn nilnndhdllkksqltelilkhfpflaamcyhppkkegkkkgsqkeqqkekeneaqsqae alnpselikvlktlvkqlrtlrnyyshhshkkpdaekdifkhlykafdaslrmvkedyka hftvnitqdfahlnrkgknkqdnpdfdlyffekdgfftesgllfftnlfldkrdaywmlk kvsgfkashkqsekmttevfcrsrillpkftlesrydhnqmlldmlselstypkllyekl seedkkrfqveadgfldeieeeqnpfkdtlirhqdrfpyfalryldlnesfksirfqvdl gtyhyciydkkigdeqekrhltrtllsfgrlqdfteinrpqewkaltkdldyketskqpf iskttphyhitdnkigfrlgtskelypslevkdganriaqypynsdfrahafisvhellp lmfyqhltgksedllketvrhiqriykdfeeerintiedlekanqgrlplgafpkqmlgl lqnkqpdlsekakikiekliaetkllshrlntklksspklgkrrekliktgvladwlvkd fmrfqpvaydaqnqpiesskanstefqliqralalyggeknrlegyfkqtnligntnphp flnkfnwkacrnlvdfyqqyleqrekfleaiknqpwepyqyclllkipkenrknlvkgwe qggislprglfteairetlskdltlskpirkeikkhgrvgfisraitlyfrekyqddhqs fydlpykleakasplpkkehyeywqqnkpqsptelqrlelhtsdrwkdyllykrwqhlek klrlyrnqdvmlwlmtleltknhfkelnlnyhqlklenlavnvqeadaldnpinqtlpmv lpvkvypatafgevqyetpirtvyireeqtkalkmgnfkalvkdrrlnglfsfikeend tqkhpisqlrlrreleiyqslrvdafketlnleekllkkhtslssvenkfrilleewkke yaassmvtdehiafiasvrnafchnqypfyeealhapiplftvaqqtteekdglgiaeal lrvlreyceivksqi |
| Prevotella saccharolytica F0055 (AMEP01000091.1) >EKY00089.1 (SEQ ID NO: 129) | mmekenvqgshiyyeptdkcfwaafynlarhnayltiahinsfvnskkginnddkvldii ddwskfdndllmgarinklilkhfpflkaplyqlakrktrkqqgkeqqdyekkgdedpev iqeaianafkmnvrktlhaflkqledlrnhfshynynspakkmevkfddgfcnklyyvf daalqmvkddnrmnpeinmqtdfehlvrlgrnrkipntfkynftnsdgtinrmgllffvs lflekrdaiwmqkkikgfkggtenymrmtnevfcrnrmvipklrletdydnhqlmfdmln elvrcplslykrlkqedqdkfrvpiefldedneadnpyqenansdenpteetdplkntiv rhqhrfpyfvlryfdlnevfkqlrfqinlgcyhfsiydktigertekrhltrtlfgfdrl qnfsvklqpehwknmvkhldteessdkpylsdamphyqienekigihflktdtekketvw psleveevssmnkykseknitadaflsthellpmnifyyqllsseektraaagdkvqgvl qsyrkkifdiyddfangtinsmqklderlakdnllrgnmpqqmlailehqepdmeqkake kldrlitetkkrigkledqfkqkvrigkrradlpkvgsiadwlyndmmifqpakrnadnt gvpdskansteyrllqealafysaykdrlepyfrqvnliggtnphpflhrvdwkkcnhll sfyhdyleakeqylshlspadwqkhqhflllkvrkdiqnekkdwkkslvagwkngfnlpr glfteasiktwfstdadkvqitdktlfenrvgliaklipyydlwyndkpqpfyqypfnin drykpedtrkrftaassklwnekkmlyknaqpdssdkieypqyldflswklderelrmlr nqdmmvwlmckdlfaqctvegvefadlkslqevdvnvqdnlnvinnvssmilplsvyps daqgnvlrnskplhtvyvqenntkllkqgnfksllkdrrlnglfsfiaaegedlqqhplt knrleyelsiyqtnirisvfeqtlqlekailtmkticgnnfnnllnswsehrtdkktlqp didfliavrnafshnqypmstntvmqgiekfniqtpkleekdglgiasqlakktkdaasr lqniinggtn |
| Prevotella saccharolytica JCM 17484 (NZ_BAKN01000001.1) >WP_051522484.1 | medkpfwaaffnlarhnvyltvnhinklldleklydegkhkeiferedifnisddvmnda nsngkkrkldikkiwddldtdltrkyqlrelilkhfpfiqpaiigaqtkerttidkdkrs tstsndslkqtgegdindllslsnvksmffrllqileqlrnyyshvkhsksatmpnfded llnwmryifidsvnkkedyssnsvidpntsfshliykdeqgkikpciypftskdgsina |

TABLE 5-continued

| Cas1b | |
|---|---|
| Cas13b orthologs | |
| (SEQ ID NO: 130) COMMENT REF SEQ: This record represents a single, non-redundant, protein sequence which may be annotated on many different RefSeq genomes from the same, or different, species (suppressed in databse) | fgllffvslflekqdsiwmqkkipgfkkasenymkmtnevfcrnhillpkirletvydkd wmlldmlnevvrcplslykrltpaaqnkfkvpekssdnanrqeddnpfsrilvrhqnrfp yfvliffdlnevftttlifqinlgcyhfaickkqigdkkevhhlirtlygfsrlqnftqnt rpeewntlykttepssgndgktvqgvplpyisytiphyqienekigikifdgdtavdtdi wpsvstekqlnkpdkytltpgfkadvflsvhellpmmfyyqllllcegmlktdagnavekv lidtrnaifnlydafvqekintitdlenylqdkpilighlpkqmidllkghqrdmlkave qkkamlikdterrlklldkqlkqetdvaakntgtllknggiadwlvndmmrfqpvkrdke gnpincskansteyqmlqrafafyatdscrlsryftqlhlihsdnshlflsifeydkqpn liafyaaylkaklefllnelqpqnwasdnyfllllrapkndrqklaegwkngfnlprglfte kiktwfnehktivdisdcdifknrvgqvarlipvffdkkfkdhsqpfyrydfnvgnvskp teanylskgkreelfksyqnkiknnipaektkeyreyknfslwkkferelrliknqdili wlmcknlfdekikpkkdilepriaysyikldslqtntstagslnalakvvpmtlaihids pkpkgkagnnekenkeftvyikeegtkllkwgnfkttlladrrikglfsyiehddidlkqh pltkrvvdleldlyqtcridifqqtlgleaqlldkysdlntdnfyqmligwrkkegiprn ikedtdflkdvrnafshnqypdskkiafrrirkinpkelileeeeglgiatqmykevekv vnrikrielfd |
| Prevotella buccae ATCC 33574 (AEPD01000005.1) >EFU31981.1 (SEQ ID NO: 131) | mqkqdklfvdrkknaifafpkyitimenkekpepiyyeltdkhfwaaflnlarhnvytti nhinrrleiaelkddgymmgikgswneqakkldkkvrlrdlimkhfpfleaaayemtnsk spnnkeqrekeqsealslnnlknvlfiflekqlvlrnyyshykyseespkpifetsllkn mylwfdanvrlykrdymhhenidmqrdfthlnrkkqvgrtkniidspnfhyhfadkegnm tiagllffvslfldkkdaiwmqkklkgfkdgrnlreqmtnevfcrsrislpklklenvqt kdwmqldmlnelvrcpkslyerlrekdresflwpfdifsddynaeeepfkntivrhqdrf pyfvlryfdlneifeqlrfqidlgtyhfsiynkrigdedevrhlthhlygfariqdfapq nqpeewrklvkdldhfetsqepyisktaphyhlenekigikfcsahnnlfpslqtdktcn grskfnlgtqftaeaflsvhellpmmfyyllltkdysrkesadkvegiirkeisniyaiy dafanneinsiadltrrlqntnilqghlpkqmisilkgrqkdmgkeaerkigemiddtqr rldllckqtnqkirigkrnagllksgkiadwlvndmmifqpvqkdqnnipinnskanste yrmlqralalfgsenfrlkayfnqmnlvgndnphpflaetqwehqtnilsfyrnyleark kylkglkpqnwkqyqhflilkvqktnintivtgwknsfnlprgiftqpirewfekhrmsk riydqilsfdivgfrakaiplyfaeeykdnvqpfydypfnignrlkpkkrqfldkkeive lwqknkelfknypsekkktdlayldflswkkferelrliknqdivtwlmfkelfnmatve glkigeihlrdidtntaneesnnilnrimpmldpvktyetdnkgnilkerplaffyieet etkvlkqgnfkalvkdrringlfsfaettdlnleehpisklsvdlelikyqttrisifem tlglekklidkystlptdsfrnmlerwlqckanrpelknyvnsliavrnafshnqypmyd atlfaevkkitlfpsvdtkkielniapqlleivgkaikeieksenkn |
| Prevotella buccae ATCC 33574 (NZ_GL586311.1) >WP_004343973.1 (SEQ ID NO: 132) | mqkqdklfvdrkknaifafpkyitimenkekpepiyyeltdkhfwaaflnlarhnvytti nhinrrleiaelkddgymmgikgswneqakkldkkvrlrdlimkhfpfleaaayemtnsk spnnkeqrekeqsealslnnlknvlfiflekqlvlrnyyshykyseespkpifetsllkn mylwfdanvrlykrdymhhenidmqrdfthlnrkkqvgrtkniidspnfhyhfadkegnm tiagllffvslfldkkdaiwmqkklkgfkdgrnlreqmtnevfcrsrislpklklenvqt kdwmqldmlnelvrcpkslyerlrekdresflwpfdifsddynaeeepfkntivrhqdif pyfvlryfdlneifeqlrfqidlgtyhfsiynkrigdedevrhlthhlygfariqdfapq nqpeewrklvkdldhfetsqepyisktaphyhlenekigikfcsahnnlfpslqtdktcn grskfnlgtqftaeaflsvhellpmmfyyllltkdysrkesadkvegiirkeisniyaiy dafanneinsiadltrrlqntnilqghlpkqmisilkgrqkdmgkeaerkigemiddtqr rldllckqtnqkirigkrnagllksgkiadwlyndmmffqpvqkdqnnipinnskanste yrmlqralalfgsenfrlkayfnqmnlvgndnphpflaetqwehqtnilsfyrnyleark kylkglkpqnwkqyqhflilkvqktnintivtgwknsfnlprgiftqpirewfekhrmsk riydqilsfdivgfrakaiplyfaeeykdnvqpfydypfnignrlkpkkrqfldkkeive lwqknkelfknypsekkktdlayldflswkkferelrliknqdivtwlmfkelfnmatve glkigeihlrdidtntaneesnnilnrimpmldpvktyetdnkgnilkerplaffyieet etkvlkqgnfkalvkdrringlfsfaettdlnleehpisklsvdlelikyqttrisifem tlglekklidkystlptdsfrnmlerwlqckam-pelknyvnsliavrnafshnqypmyd atlfaevkkftlfpsvdtkkielniapqlleivgkaikeieksenkn |
| Prevotella buccae D17 (NZ_GG739967.1) >WP_004343581.1 (SEQ ID NO: 133) | mqkqdklfvdrkknaifafpkyitimenqekpepiyyeltdkhfwaaflnlarhnvytti nhinrrleiaelkddgymmdikgswneqakkldkkvrlrdlimkhfpfleaaayeitnsk spnnkeqrekeqsealslnnlknvlfiflekqlvlrnyyshykyseespkpifetsllkn mylwfdanvrlykrdymhhenidmqrdfthlnrkkqvgrtkniidspnfhyhfadkegnm tiagllffvslfldkkdaiwmqkklkgfkdgrnlreqmtnevfcrsrislpklklenvqt kdwmqldmlnelvrcpkslyerlrekdresflwpfdifsddyaeeepfkntivrhqdif pyfvlryfdlneifeqlrfqidlgtyhfsiynkrigdedevrhlthhlygfariqdfaqq nqpevwrklykdldyfeasqepyipktaphyhlenekigikfcsthnnlfpslktektcn grskfnlgtqftaeaflsvhellpmmfyyllltkdysrkesadkvegiirkeisniyaiy dafangeinsiadltcrlqktnilqghlpkqmisilegrqkdmekeaerkigemiddtqr rldllckqtnqkirigkrnagllksgkiadwlyndmmffqpvqkdqnnipinnskanste yrmlqralalfgsenfrlkayfnqmnlvgndnphpflaetqwehqtnilsfyrnyleark kylkglkpqnwkqyqhflilkvqktnintivtgwknsfnlprgiftqpirewfekhrmsk riydqilsfdivgfvakaiplyfaeeykdnvqpfydypfnignrlkpkqkgqfldkkerve lwqknkelfknypsekkktdlayldflswkkferelrliknqdivtwlmfkelfnmatve glkigeihlrdidtntaneesnnilnrimpmklpvktyetdnkgnilkerplatfyieet etkvlkqgnflcvlakdrngllsfaettdidleknpitklsvdhelikyqttrisifem tlglekklinkyptlptdsfrnmlerwlqckanrpelknyvnsliavrnafshnqypmyd atlfaevkkftlfpsvdtkkielniapqlleivgkaikeieksenkn |

TABLE 5-continued

| Cas1b |
| --- |

| Cas13b orthologs | |
| --- | --- |
| *Prevotella sp.* MSX73<br>(NZ_ALJQ01000043.1)<br>>WP_007412163.1<br>(SEQ ID NO: 134) | mqkqdklfvdrkknaifafpkyitimenqekpepiyyeltdkhfwaaflnlarhnvytti<br>nhinrrleiaelkddgymmgikgswneqakkldkkvrlrdlimkhfpfleaaayeitnsk<br>spnnkeqrekeqsealslnnlknvlfifleklqvlrnyyshykyseespkpifetsllkn<br>mykvfdanvrlvkrdymhhenidmqrdfthlnrkkqvgrtkniidspnfhyhfadkegnm<br>tiagllffvslfldkkdaiwmqkklkgfkdgrnlreqmtnevfcrsrislpklklenvqt<br>kdwmqldmlnelvrcpkslyerlrekdresfkvpfdifsddydaeeepflmtivrhqdrf<br>pyfvlryfdlneifeqlrfqidlgtyhfsiynkrigdedevrhlthhlygfariqdfapq<br>nqpeewrklykdldhfetsqepyisktaphyhlenekigikfcsthnnlfpslkrektcn<br>grskfnlgtqftaeaflsvhellpmmfyyllltkdysrkesadkvegiirkeisniyaiy<br>dafanneinsiadltcrlqktnilqghlpkqmisilegrqkdmekeaerkigemiddtqr<br>rldllckqtnqkirigkrnagllksgkiadwlvsdmmrfqpvqkdtnnapinnskanste<br>yrmlqhalalfgsessrlkayfrqmnlvgnanphpflaetqwehqtnilsfyrnyleark<br>kylkglkpqnwkqyqhflilkvqktnrntivtgwknsfnlprgiftqpirewfekhrmsk<br>riydqilsfdrvgfvakaiplyfaeeykdnvqpfydypfnignklkpqkgqfldkkerve<br>lwqknkelfknypseknktdlayldflswkkferelrliknqdivtwlmfkelfktttve<br>glkigeihlrdidtntaneesnnilnrimpmklpvktyetdnkgnilkerplatfyieet<br>etkvlkqgnflcvlakdrdngllsfaettdidleknpitklsvdyelikyqttrisifem<br>tlglekklidkystlptdsfrnmlerwlqckanrpelknyvnsliavrnafshnqypmyd<br>atlfaevkkftlfpsvdtkkielniapqlleivgkaikeiekenkn |
| *Prevotella pallens* ATCC<br>700821<br>(AFPY01000052.1)<br>>EGQ18444.1<br>(SEQ ID NO: 135) | mkeeekgktpvvstynkddkhfwaaflnlarhnvyitvnhinkilgegeinrdgyentle<br>kswneikdinkkdrlskliikhfpflevttyqrnsadttkqkeekqaeaqsleslkksff<br>vfiyklrdlrnhyshykhskslerpkfeedlqekmynifdasiqlvkedykhntdiktee<br>dfkhldrkgqfkysfadnegnitesgllffvslflekkdaiwvqkklegfkcsnesyqkm<br>tnevfcrsrmllpklrlqstqtqdwilldmlnelircpkslyerlreedrkkfrvpieia<br>dedydaeqepfknalvrhqthfpyfallyfdyneiftnlifqidlgtyhfsiykkqigdy<br>keshhlthklygferiqeftkqnrpdewrkivktfnsfetskepyipettphyhlenqki<br>giffindndkiwpslktnseknekskykldksfqaeaflsvhellpmmfyyllltentd<br>ndneietkkkenkndkqekhkieeiienkiteiyalydafangkinsidkleeyckgkdi<br>eighlpkqmiailksehkdmateakrkqeemladvqkslesldnqineeienverknssl<br>ksgeiaswlvndmmrfqpvqkdnegnplnnskansteyqmlqrslalynkeekptryfrq<br>vnliessnphpflnntewekcnnilsfyrsyleakknfleslkpedweknqyflmlkepk<br>tncetivqgwkngfnlprgiftepirkwfmehrknitvaelkrvglvakviplffseeyk<br>dsvqpfynylfnvgninkpdeknflnceerrellrkkkdefkkmtdkekeenpsylefqs<br>wnkferelrlvrnqdivtwllcmelfnkkkikelnvekiylknintnttkkeknteekng<br>eekiikeknnilnrimpmrlpikvygrenfsknkkkkirrntfftvyieekgtkllkqgn<br>fkalerdrrlgglfsfvkthskaesksntisksrveyelgeyqkarieiikdmlaleetl<br>idkynsldtdnfhnmltgwlklkdepdkasfqndvdlliavrnafshnqypmrnriafan<br>inpfslssantseekglgianqlkdkthktiekiieiekpietke |
| *Prevotella pallens* ATCC<br>700821<br>(NZ_GL982513.1)<br>>WP_006044833.1<br>(SEQ ID NO: 136) | mkeeekgktpvvstynkddkhfwaaflnlarhnvyitvnhinkilgegeinrdgyentle<br>kswneikdinkkdrlskliikhfpflevttyqrnsadttkqkeekqaeaqsleslkksff<br>vfiyklrdlrnhyshykhskslerpkfeedlqekmynifdasiqlvkedykhntdiktee<br>dfkhldrkgqfkysfadnegnitesgllffvslflekkdaiwvqkklegfkcsnesyqkm<br>tnevfcrsrmllpklrlqstqtqdwilldmlnelircpkslyerlreedrkkfrvpieia<br>dedydaeqepfknalvrhqthfpyfallyfdyneiftnlifqidlgtyhfsiykkqigdy<br>keshhlthklygferiqeftkqnrpdewrkivktfnsfetskepyipettphyhlenqki<br>giffindndkiwpslktnseknekskykldksfqaeaflsvhellpmmfyyllltentd<br>ndneietkkkenkndkqekhkieeiienkiteiyalydafangkinsidkleeyckgkdi<br>eighlpkqmiailksehkdmateakrkqeemladvqkslesldnqineeienverknssl<br>ksgeiaswlvndmmrfqpvqkdnegnplnnskansteyqmlqrslalynkeekptryfrq<br>vnliessnphpflnntewekcnnilsfyrsyleakknfleslkpedweknqyflmlkepk<br>tncetivqgwkngfnlprgiftepirkwfmehrknitvaelkrvglvakviplffseeyk<br>dsvqpfynylfnvgnlnkpdeknflnceerrellrkkkdefkkmtdkekeenpsylefqs<br>wnkferelrlvrnqdivtwllcmelfnkkkikelnvekiylknintnttkkeknteekng<br>eekiikeknnilnrimpmrlpikyygrenfsknkkkkirrntfftvyieekgtkllkqgn<br>fkalerdrrlgglfsfvkthskaesksntisksrveyelgeyqkarieiikdmlaleetl<br>idkynsldtdnfhnmltgwlklkdepdkasfqndvdlliavrnafshnqypmrnriafan<br>inpfslssantseekglgianqlkdkthktiekiieiekpietke |
| *Prevotella intermedia*<br>ATCC 25611 = DSM<br>20706<br>(NZ_JAEZ01000017.1)<br>>WP_036860899.1<br>(SEQ ID NO: 137) | meddkkttdsiryelkdkhfwaaflnlarhnvyitvnhinkileegeinrdgyettlknt<br>wneikdinkkdrlskliikhfpfleaatyrinptdttkqkeekqaeaqslesrksffvf<br>iyklrdlmhyshykhskslerpkfeeglIekmynifnasirlykedyclynkdinpdedf<br>khldrteeefnyyftkdnegnitesgllffvslflekkdaiwmqqklrgfkdnrenkkkm<br>tnevfcrsrmllpklrlqstqtqdwilldmlnelircpkslyerlreedrekfrvpieia<br>dedydaeqepfkntlvrhqdrfpyfalrylfdyneiftnlrfqidlgtyhfsiykkqigdy<br>keshhlthklygferiqeftkqnrpdewrkivktfnsfetskepyipettphyhlenqki<br>giffindndkiwpslktnseknekskykldksfqaeaflsvhellpmmfyylllktentd<br>ndneietkkkenkndkqekhkieeiienkiteiyalydlfangeiksideleeyckgkdi<br>eighlpkqmiailkdehkvmateaerklvdvqkslesldnqineeienverknssl<br>ksgkiaswlyndmmrfqpvqkdnegkpinnskansteyqllqrtlaffgseherlapyfk<br>qtkliessnphpflkdtewekcnnilsfyrsyleakknfleslkpedweknqyflklkep<br>ktkpktivqgwkngfnlprgiftepirkwfmkhrenitvaelkrvglvakviplffseey<br>kdsvqpfynyhfnvgninkpdeknflnceerrellrkkkdefkkmtdkekeenpsylefk<br>swnkferelrlvrnqdivtwllcmelfnkkkikelnvekiylknintnttkkeknteekn |

TABLE 5-continued

| Cas1b |
|---|
| Cas13b orthologs |

| | |
|---|---|
| | geeknikeknnilnrimpmrlpikvygrenfsknkkkkirrnifftvyieekgtkllkqg<br>nfkalerdrrlgglfsfvktpskaesksntisklrveyelgeyqkarieiikdmlalekt<br>lidkynsldtdnfnkmlidwlelkgepdkasfqndvdlliavrnafshnqypmrnriafa<br>ninpfslssantseekglgianqlkdkthktiekiieiekpietke |
| *Prevotella intermedia*<br>(NZ_LBGT01000010.1)<br>>WP_061868553.1<br>(SEQ ID NO: 138) | meddkkttdsiryelkdkhfwaaflnlarhnvyitvnhinkileedeinrdgyentlens<br>wneikdinkkdrlskliikhfpfleattyrqnpfdttkqkeekqaeaqsleslkksffvf<br>iyklrdlmhyshykhskslerpkfeedlqnkmynifdvsiqfvkedykhntdinplckdf<br>khldrkrkgkfhysfadnegnitesgllfivslflekkdaiwvqkklegfkcsnksyqkm<br>tnevfcrsrmllpklrlestqtqdwilldmlnelircpkslyerlqgvnrkkfyvsfdpa<br>dedydaeqepfkntivrhqdrfpyfalryfdynevfanlrfqidlgtyhfsiykkliggq<br>kedrhlthklygferiqefdkqnrpdewkaivkdsdlfkkkeekeeekpyisettphyhl<br>enkkigiafknhniwpstqteltnnkrkkynlgtsikaeaflsvhellpmmfyyllikte<br>ntkndnkvggkketkkqgkhkieaiieskikdiyalydafangeinsedelkeylkgkdi<br>kivhlpkqmiailknehkdmaekaeakqekmklatenrlktldkqlkgkiqngklynsap<br>ksgeiaswlyndmmrfqpvqkdengeslnnskansteyqllqrtlaffgseherlapyfk<br>qtkliessnphpflndtewekcsnilsfyrsylkarknfleslkpedweknqyflmlkep<br>ktnretlvqgwkngfnlprgiftepirkwfmehwksikvddlkrvglvakvtplffseky<br>kdsvqpfynypfnvgdvnkpkeedflhreerielwdkkkdkfkgykakkkikemtdkeke<br>ehrsylefqswnkferelrlvrnqdivtwllctelidklkidelnikelkklrlkdintd<br>takkeknnilm-vmpmelpvtvykynkggyiiknkplhtiyikeaetkllkqgnfkalvk<br>dn-lnglfsfvktpseaesesnpisklrveyelgkyqnarldiiedmlalekklidkyns<br>ldtdnfhnmltgwlelkgeakkarfqndvklltavrnafshnqypmydenlfgnielfsl<br>sssniieskgldiaaklkeevskaakkigneednkkeket |
| *Prevotella intermedia* 17<br>(CP003502.1)<br>>AFJ07523.1<br>(SEQ ID NO: 139) | mkmeddkktkestnmldnkhfwaaflnlarhmiyitvnhinkvlelknkkdqdiiidndq<br>dilaikthwekvngdlnkterlrelmtkhfpfletaiytknkedkeevkqekqakaqsfd<br>slkhclflfleklqearnyyshykysestkepmlekellkkmynifddniqlvikdyqhn<br>kdinpdedfkhldrteeefnyyfttnkkgnitasgllffvslflekkdaiwmqqklrgfk<br>dnreskkkmthevfcrsrmllpklflestqtqdwilldmlnelircpkslyerlqgeyrk<br>kfnvpfdsadedydaeqepfkntivrhqdrfpyfalryfdyneiftnlrfqidlgtyhfs<br>iykkliggqkedrhlthklygferiqefakqnrtdewkaivkdfdtyetseepyisetap<br>hyhlenqkigirfrndndeiwpslktngennekrkykldkqyqaeaflsvhellpmmfyy<br>lllkkeepnndkknasivegfikreirdiyklydafangeinniddlekycedkgipkrh<br>lpkqmvailydehkdmaeeakrkqkemvkdtkkllatlekqtqgeiedggrnirllksge<br>iarwlvndmmrfqpvqkdnegnpinnskansteyqmlqrslalynkeekptlyfrqvnli<br>nssnphpflkwtkweecnnilsfyrsylikkieflnklkpedweknqyflklkepktnre<br>tivqgwkngfnlprgiftepirewfkrhqndseeyekvetldrvglvtkviplffkkeds<br>kdkeeylkkdaqkeinncvqpfygfpynvgnihkpdekdflpseerkklwgdkkykfkgy<br>kakvkskkltdkekeeyrsylefqswnkferelrlvrnqdivtwllctelidklkveglg<br>veelkklrlkdidtdtakqeknnilnrvmpmqlpvtvyeiddshnivkdrplhtvyieet<br>ktkllkqgnfkalvkdrflnglfsfvdtssetelksnpisksl veyelgeyqnarietik<br>dmilleetliekyktlptdnfsdmingwlegkdeadkarfqndvklllavrnafshnqyp<br>mrnriafaninpfslssadtseekkldianqlkdkthkiikriieiekpietke |
| *Prevotella intermedia*<br>(NZ_AP014926.1)<br>>WP_050955369.1<br>(SEQ ID NO: 140)<br>COMMENT<br>REF SEQ: This record<br>represents a single, non-<br>redundant, protein<br>sequence which may be<br>annotated on many<br>different RefSeq<br>genomes from the same,<br>or different, species<br>(suppressed in databse) | meddkkktkestnmldnkhfwaaflnlarhnvyitvnhinkvlelknkkdqdiiidndqdi<br>laikthwekvngdlnkterlrelmtkhfpfletaiytknkedkeevkqekqakaqsfdsl<br>khclflfleklqearnyyshykysestkepmlekellkkmynifddniqlvikdyqhnkd<br>inpdedfkhldrteeefnyyfttnkkgnitasgllffvslflekkdaiwmqqklrgfkdn<br>reskkkmthevfcrsrmllpklrlestqtqdwilldmlnelircpkslyerlqgeyrkki<br>nvpfdsadedydaeqepfkntivrhqdifpyfalryfdyneiftnlifqidlgtyhfsiy<br>kkliggqkedrhlthklygferiqefakqnrtdewkaivkdfdtyetseepyisetaphy<br>hlenqkigirfindndeiwpslktngennekrkykldkqyqaeaflsvhellpmmfyyll<br>kkeepnndkknasivegfikreirdiyklydafangeinniddlekycedkgipkrhlp<br>kqmvailydehkdmaeeakrkqkemvkdtkkllatlekqtqgeiedgginirllksgeia<br>rwlyndmmrfqpvqkdnegnpinnskansteyqmlqrslalynkeekptryfrqvnlins<br>snphpflkwtkweecnnilsfyrsyltkkieflnklkpedweknqyflklkepktnretl<br>vqgwkngfnlprgiftepirewfkrhqndseeyekvetldrvglvtkviplffkkedskd<br>keeylkkdaqkeinncvqpfygfpynvgnihkpdekdflpseerkklwgdkkykfkgyka<br>kvkskkltdkekeeyrsylefqswnkferelrlvinqdivtwllctelidklkveglnve<br>elkklrlkdidtdtakqeknnilnrvmpmqlpvtvyeiddshnivkdrplhtvyieetkt<br>kllkqgnfkalvkdrrlnglfsfvdtssetelksnpisksl veyelgeyqnarietikdm<br>llleetliekyktlptdnfsdmlngwlegkdeadkarfqndvklllavinafshnqypmr<br>nriafaninpfslssadtseekkldianqlkdkthkiikriieiekpietke |
| *Prevotella intermedia*<br>(AP014598.1)<br>BAU18623.1<br>(SEQ ID NO: 141) | meddkkttdsisyelkdkhfwaaflnlarhnvyitvnhinkvlelknkkdqdiiidndqd<br>ilaikthwekvngdlnkterlrelmtkhfpfletaiysknkedkeevkqekqakaqsfds<br>lkhclflfleklqetrnyyshykysestkepmlekellkkmynifddniqlvikdyqhnk<br>dinpdedfkhldrteedfnyyftrnkkgnitesgllfffvslflekkdaiwmqqklrgfkd<br>nreskkkmthevfcrsrmllpklrlestqtqdwilldmlnelircpkslyerlqgedrek<br>fkvpfdpadedydaeqepfkntivrhqdrfpyfalryfdyneiftnlifqidlgtfhfsi<br>ykkliggqkedrhlthklygferiqefakqnrpdewkaivkdldtyetsneiyisettph<br>yhlenqkigirfrndndeiwpslktngennekskykldkqyqaeaflsvhellpmmfyyl<br>llkkeepnndkknasivegfikreirdmyklydafangeinniddlekycedkgipkrhl<br>pkqmvailydehkdmvkearkrqkmvkdtekllaalekqtqektedggginirllksgei<br>arwlvndmmifqpvqkdnegnpinnskansteyqmlqrslalynkeekptryfrqvnlin |

TABLE 5-continued

| Cas1b | |
|---|---|
| Cas13b orthologs | |
| | ssnphpflkwtkweecnnilsfyrsyltkkieflnklkpedwekneflklkepktriret
lvqgwkngfnlprgiftepirewfkrhqndskeyekvealdryglvtkviplfffkkedsk
dkeedlkkdaqkeinncvqpfysfpynvgnihkpdekdflhreerielwdkkkdkfkgyk
akvkskkltdkekeeyrsylefqswnkferelrlvrnqdivtwllctelidklkveglnv
eellkklrlkdidtdtakqeknnilnrvmpmqlpvtvyeiddshnivkdrplhtvyieetk
tkllkqgnfkalvkdrrlnglfsfvdtsseaelksnpiskslveyelgeyqnarietikd
milleetliekyknlptdnfsdmlngwlegkdeadkarfqndvkllvavinafshnqypm
rnriafaninpfslssadtseekkldianqlkdkthkiikriieiekpietke |
| *Prevotella intermedia* ZT
(ATMK01000017.1)
>KJJ86756.1
(SEQ ID NO: 142) | mkmeddkkttestnmldnkhfwaaflnlarhnvyitvnhinkvlelknkkdqdiiidndq
dilaikthwekvngdlnkterlrelmtkhfpfletaiytknkedkeevkqekqaeaqsle
slkdclflfleklqearnyyshykysestkepmleegllekmynifddniqlvikdyqhn
kdinpdedflchldrkgqfkysfadnegnitesgllffvslflekkdaiwmqqkhgfkdn
reskkkmthevqfcrrrmllpklrlestqtqdwilldmlnelircpkslyerlqgeyrkkf
nvpfdsadedydaeqepfkntivrhqdifpyfalryfdyneiftnlifqidlgtyhfsiy
kkliggqkedrhlthklygferiqefakqnrpdewkalvkdldtyetsneryisettphy
hlenqkigirfingnkeiwpslktngennekskykldkpyqaeaflsvhellpmmfyyll
lkkeepnndkknasivegfikreirdmyklydafangeinnigdlekycedkgipkrhlp
kqmvailydepkdmvkeakrkqkemvkdtkkllatlekqteeiedgginirllksgeia
rwlyndmmifqpvqkdnegnpinnskansteyqmlqrslalynkeekptiyfrqvnlins
snphpflkwacweecnnilsfyinyltkkieflnklkpedweknqyflklkepktnretl
vqgwkngfnlprgiftepirewfkrhqndskeyekvealkrvglvtkviplffkeeyfke
daqkeinncvqpfysfpynvgnihkpdekdflpseerkldwgdkkdkfkgyakvkskkl
tdkekeeyrsylefqswnkferelrlvrnqdivtwllctelidkmkveglnveelqklrl
kdidtdtakqeknnilm-impmqlpvtvyeiddshnivkdrplhtvyieettktkllkqgn
fkalvkdrrlnglfsfvdtsskaelkdkpisksvveyelgeyqnarietikdmillektl
ikkyeklptdnfsdmlngwlegkdesdkarfqndvkllvavinafshnqypmnifiafan
inpfslssadiseekkldianqlkdkthkiikkiieiekpietke |
| *Prevotella aurantiaca*
JCM 15754
(NZ_BAKF01000019.1)
>WP_025000926.1
(SEQ ID NO: 143) | meddkkttgsisyelkdkhfwaaflnlarhnvyitinhinklleireidndekvldiktl
wqkgnkdlnqkarlrelmtkhfpfletaiytknkedkkevkqekqaeaqsleslkdclfl
fldldqearnyyshykysefskepefeeggllekmynifgnniqlvindyqhnkdinpded
fkhldrkgqfkysfadnegnitesgllffvslflekkdaiwmqqklngfkdnlenkkkmt
hevqfcrsrilmpklrlestqtqdwilldmlnelircpkslyerlqgdkpvfdpad
edynaeqepfkntlirhqdifpyfvlryfdyneifknlifqidlgtyhfsiykklig gqk
edrhlthklygferiqefakqm-pdewkaivkdldtyetsnkiyisettphyhlenqkig
irfingnkeiwpslktndennekskykldkpyqaeaflsvhellpmmfyyllkkekpnn
deinasivegfikreirnifklydafangeinniddlekycadkgipkrhlpkqmvaily
dehkdmvkeakrkqkemvkdtkkllatlekqtkekeddgrnvkllksgeiarwlvndmm
rfqpvqkdnegkpinnskansteyqmlqrslalynneekptryfrqvnliesnnphpflk
wtkweecnnillfyysylikkieflnklkpedwklmqyflklkepktnretivqgwkngf
nlprgiftepirewfkrhqnnskeyekvealdrvglvtkviplfffkeeyfkdkeenfked
tqkeindcvqpfynfpynvgnihkpekdflhreerielwdkkkdkfkgykekikskklt
ekdkeefrsylefqswnkferelrlvrnqdivtwllckelidklkidelnieelkkftln
nidtdtakkeknnilnrvmpmelpvtvyeiddshkivkdkplhtiyikeaetkllkqgnf
kalvkdrrlnglfsfvktnseaeskrnpisklrveyelgeyqearieliqdmlaleekli
nkykdlptnkfsemlnswlegkdeadkarfqndvfliavrnafshnqypmhnkiefani
kpfslytannseekglgianqlkdktkettdkikkiekpietke |
| *Prevotella pleuritidis*
F0068
(NZ_AWET01000045.1)
>WP_021584635.1
(SEQ ID NO: 144)
COMMENT
REF SEQ: This record
represents a single, non-
redundant, protein
sequence which may be
annotated on many
different RefSeq
genomes from the same,
or different, species
(suppressed in databse) | mendkrleesacytlndkhfwaaflnlarhnvyitvnhinktlelknkknqeiiiidndqd
ilaikthwakvngdlnktdrlrelmikhfpfleaaiysnnkedkeevkeekqakaqsfks
lkdclflfleklqearnyyshykysesskepefeeggllekmyntfdasirlvkedyqnk
didpekdfkhlerkedfnylftdkdnkgkitkngllffvslflekkdaiwmqqkfrglkd
nrgnkekmthevqfcrsrmllpkirlestqtqdwilldmlnelircpkslyerlqgayrek
fkvpfdsidedydaeqepfrntlvrhqdrfpyfalryfdyneifknlrfqidlgtyhfsi
ykkliggkkedrhlthklygferiqeftkqnrpdkwqaiikdldtyetsnelyisettph
yhlenqkigirfrndnndiwpslktngeknekskynldkpyqaeaffsvhellpmmfyyl
llkmentdndkednevgtkkkgnknnkqekhkieeiienkikdiyalydaftngeinsid
elaegregkdieighlpkqlivilknksdkmaekanrkqkemikdtkkrlatldkqvkge
iedggrnirllksgeiarwlyndmmrfqpvqkdnegkpinnskansteyqmlqrslalyn
keekptryfrqvnlikssnphpfledtkweecynilsfyrnylkakikflnklkpedwkk
nqyflmlkepktnrktivqgwkngfnlprgiftepikewfkrhqndseeykkvealdrvg
lvakviplfffkeeyfkedaqkeinncvqpfysfpynvgnihkpeeknflhceerrklwdk
kkdkfkgykakekskkmtdkekeehrsylefqswnkferelrlvrnqdiftwllctklid
klkidelnieeelqklrlkdidtdtakkeknnilnrvmpmrlpvtvyeidksfnivdkpl
htvyieetgtkllkqgnfkalvkdrrlnglfsfvktsseaeskskpisklrveyelgayq
karidiikdmlalektlidnnenlptnkfsdmlkswlkgkgeankarlqndvgllvavrn
afshnqypmynsevfkgmkllslssdipekeglgiakqlkdkiketieriieiekeirn |
| *Prevotella pleuritidis*
JCM 14110
(NZ_BAJN01000005.1)
>WP_036931485.1
(SEQ ID NO: 145)
COMMENT
REF SEQ: This record | mendkrleestcyandlchfwaaflnlarhnvyitinhinklleirqidndekvldikal
wqkvdkdinqkarlrelmikhfpfleaaiysnnkedkeevkeekqakaqsfkslkdclfl
fleklqearnyyshykssesskepefeeggllekmyntfgvsirlvkedyqynkdidpekd
fkhlerkedfnylftdkdnkgkitkngllffvslflekkdaiwmqqklrgfkdnrgnkek
mthevqfcrsrmllpkirlestqtqdwilldmlnelircpkslyerlqgayrekftwpfds
idedydaeqepfrntlvrhqdrfpyfalryfdyneifknlrfqidlgtyhfsiykkligd
nkedrhlthklygferiqefakqkrpnewqalvkdldiyetsneqyisettphyhlenqk |

TABLE 5-continued

| Cas1b |
| --- |
| Cas13b orthologs |

| | |
|---|---|
| represents a single, non-redundant, protein sequence which may be annotated on many different RefSeq genomes from the same, or different, species (suppressed in databse) | igirfknkkdkiwpsletngkenekskynldksfqaeaflsihellpmmfydlllkkeep nndeknasivegfikkeikrmyaiydafaneeinskegleeycknkgfqerhlpkqmiai ltnksknmaekakrkqkemikdtkkrlatldkqvkgeiedggrnirllksgeiarwlynd mmrfqsvqkdkegkpinnskansteyqmlqrslalynkeqkptpyfiqvnlikssnphpf leetkweecnnilsfyrsyleakknflesLkpedwkknqyflmlkepktnrktivqgwkn gfnlprgiftepikewfkrhqndseeykkvealdrvglvakvipLffkeeyfkedaqkei nncvqpfysfpynvgnihkpeeknflhceerrklwdkkkdkfkgykakekskkmtdkeke ehrsylefqswnkferelrlvrnqdivtwllctelidklkidelnieelqkftlkdidtd takkeknnilnrimpmqlpvtvyeidksfnivkdkpLhtiyieetgtkllkqgnfkalvk drrlnglfsfvktsseaeskskpisklrveyelgayqkaridiikdmlalektlidnden lptnkfsdmlkswlkgkgeankarlqndvdllvairnafshnqypmynsevfkgmkllsl ssdipekeglgiakqlkdkiketierheiekeirn |
| Prevotella falsenii DSM 22864 = JCM 15124 (NZ_BAJY01000004.1) >WP_036884929.1 (SEQ ID NO: 146) | mkndnnstkstdyngdlchfwaaflnlarhnvyitvnhinkvlelknkkdqeiiidndqd ilaiktlwgkvdtdinkkdrlrelimkhfpfleaatyqqsstnntkqkeeeqakaqsfes lkdclflfleklrearnyyshykhsksleepkleekllenmynifdtnvqlvikdyehnk dinpeedfkhlgraegefnyyftrnkkgnitesgllffvslflekkdaiwaqtkikgfkd nrenkqkmthevfcrsrmllpklrlestqtqdwilldmlnelircpkslykrlqgekrek frvpfdpadedydaeqepflntlvrhqdrfpyfalryfdyneiftnlifqidlgtyhfsi ykkqigdkkedrhlthklygferiqefakenrpdewkalvkdldtfeesnepyisettph yhlenqkigimknkkkkktiwpsletkttvnerskynlgksfkaeaflsvhellpnmify ylllnkeepnngkinaskvegiiekkirdiyklygafaneeinneeelkeycegkdiair hlpkqmiailkneykdmakkaedkqkkmikdtkkrlaaldkqvkgevedggrnikplksg riaswlyndmmrfqpvqrdrdgypinnskansteyqllqrtlalfgsererlapyfrqmn ligkdnphpflkdtkwkehnnilsfyrsyleakknflgslkpedwkknqyflklkepktn retlvqgwkngfnlprgiftepirewfirhqneseeykkvkdfdriglvakviplffked yqkeiedyvqpfygypfnvgnihnsqegtflnkkereelwkgnktkfkdyktkeknkekt nkdkfkkktdeekeefrsyldfqswkkferelrlvrnqdivtwllcmelidklkidelni eelqklrlkdidtdtakkeknnilnrimpmelpvtvyetddsnniikdkplhtiyikeae tkllkqgnfkalvkdrringlfsfvetsseaelkskpisksiveyelgeyqrarveiikd mlrleetligndeklptnkfrqmldkwlehkketddtdlkndvklltevrnafshnqypm rdriafanikpfslssantsneeglgiakklkdktketidriieieeqtatkr |
| Porphyromonas gulae (NZ_JRAT01000012.1) >WP_039418912.1 (SEQ ID NO: 147) | mteqserpyngtyytledkhfwaafinlarhnayitithidrqlayskaditndqdvlsf kalwknlndndlerksrlrslilkhfsflegaaygkklfeskssgnkssknkeltkkekee lqanalsldnlksilfdflqklkdfrnyyshyrhsgsselplfdgnmlqrlynvfdvsyq rvkrdhehndkvdphrhfnhlvrkgkkdryghndnpsfkhhfvdsegmvteagllffvsl flekrdaiwmqkkirgfkggtetyqqmtnevfcrsrislpklkleslrmddwmlldmlne lvrcpkplydrlreddracfrvpvdilpdeddtdgggedpfkntlvrhqdrfpyfalryf dikkvftslrfhidlgtyhfaiykkmigeqpedrhltrnlygfgriqdfaeehrpeewkr lvrdldyfetgdkpyisqtsphyhiekgkiglrfmpegqhlwpspevgttrtgrskyaqd krltaeaftsvheimpmmfyyflirekyseevsaekvqgrikrviedvyaiydafardei ntlkeldacladkgirrghlpkqmiailsqehlmmeekvrkklqemiadtdhrldmldrq tdrkirigrknaglpksgviadwlvrdmmrfqpvakdasgkpinnskansteyrmiqral alfggekerltpyfrqmnitggnnphpflhdtrweshtnilsfyrsylrarkaflerigr sdrmenrpfllikepktdrqfivagwksefhlprgifteavrdcliemgydevgsyrevg fmakavplyferacedrvqpfydspfnvgnsikpkkgrfiskeeraeewergkerfrdle awshsaarriedafagieyaspgnkkkieqllrdislweafeskikvradkinlakikke ileaqehpyhdfkswqkferelrlvknqdiitwmmcrdimeenkvegidtgtlylkdirt nvqeqgslnvlnhvkpmrlpvvvyradsrghvhkeeaplatvyieerdtkllkqgnfksf vkdrrlnglfsfvdtgglameqypiskirveyelakyqtarvcafeqfieleesLltryp hlpdknfrkmleswsdpllakwpelhglwriliavrnafshnqypmydeavfssirkydp sspdaieermginiahriseevkqaketveriiqa |
| Porphyromonas sp. COT-052 OH4946 (NZ_JQZY01000014.1) >WP_039428968.1 (SEQ ID NO: 148) | mteqserpyngtyytledkhfwaafinlarhnayitithidrqlayskaditndqdvlsf kalwknfdndlerksrlrslilkhfsflegaaygkklfeskssgnkssknkeltkkekee lqanalsldnlksilfdflqklkdfrnyyshyrhsesselplfdgnmlqrlynvfdvsvq wkrdhehndkvdphrhfnhlvrkgkkdryghndnpsfichhfvdsegmvteagllffvsl flekrdaiwmqkkirgfkggtetyqqmtnevfcrsrisipkiklesirtddwmlldmlne lvrcpkplydrlreddracfrvpvdilpdeddtdgggedpfkntlvrhqdrfpyfalryf dikkvftslifhidlgtyhfaiykkmigeqpedrhltrnlygfgriqdfaeehrpeewkr lvrdldyfetgdkpyisqttphyhiekgkiglrfvpegqhlwpspevgttrtgrskyaqd krltaeaftsvheimpmmfyyflirekyseevsaekvqgrikrviedvyaiydafardei ntlkeldacladkgirrghlpkqmigilserkdmeekvrkklqemiadtdhrldmldrq tdrkirigrknaglpksgviadwlvrdmmrfqpvakdtsgkpinnskansteyrmiqral alfggekerltpyfrqmnliggnnphpflhetrweshtnilsfyrsylrarkaflerigr sdrvencpfifikepktdrqtivagwkgefhiprgifteavrdcliemgydevgsyrevg fmakavplyferacedrvqpfydspfnvgnsikpkkgrfiskedraeewergkelfrdle awshsaarrikdafagieyaspgnkkkieqllrdislweafeskikvradkinlakikke ileaqehpyhdfkswqkferelrlvknqdiitwmmdfrdlmeenkvegldtgtlylkdirp nvqeqgslnvlnrvkpmrlpvvvyradsrghvhkeeaplatvyieerdtkilkqgnfksf vkdrrlnglfsfvdtgglameqypisklrveyelakyqtarvcvfelltrleeslLstyp hlpdesfremleswsdpllakwpelhgkvrlliavrnafshnqypmydeavfssirkydp sspdaieermginiahriseevkqaketveriiqa |

TABLE 5-continued

| Cas1b | |
|---|---|
| Cas13b orthologs | |
| Porphyromonas gulae (NZ_JRFD01000046.1) >WP_039442171.1 (SEQ ID NO: 149) | mteqserpyngtyytledkhfwaafinlarhnayitithidrqlayskaditndqdvisf kalwknlndndlerksrlrslilkhfsflegaaygkklfeskssgnkssknkeltkkekee lqanalsldnlksilfdflqklkdfrnyyshyrhsgsselplfdgnmlqrlynvfdvsyq wkrdhehndkvdphyhfnhlvrkgkkchyghndnpsflchhfvdsegmvteagllffvsl flekrdaiwmqkkirgfkggtgpyeqmtnevfcrsrislpklklestrtddwmlldmlne lvrcpkplydrlrekdracfrvpvdilpdeddtdgggedpfkntlvrhqdrfpyfalryf dlkkvftslrfhidlgtyhfaiykkmigeqpedrhltrnlygfgriqdfaeehrpeewkr lvrdldyletgdkpyisqttphyhiekgkiglrfvpegqhlwpspevgttrtgrskcaqd krltaeaftsvheimpmmfyyflirekyseevsaekvqgrikrviedvyaiydafardei ntlkeldtcladkgirrghlpkqmitilsgerkdmkekirkklqemiadtdhrldmldrq tdrkirigrknaglpksgviadwlvrdmmrfqpvakdasgkpinnskansteyrmiqral alfggekerltpyfrqmnitggnnphpflhetrweshtnilsfyrsylrarkaflerigr sdrvencpfififikepktdrqtivagwkdefhlprgifteavrdcliemgydevgsyrevg fmakavplyferacedrvqpfydspfnvgnsikpkkgifiskedraeewergmerfrdle awshsaarrikdafagieyaspgnkkkieqllrdislweafeskikvradkinlakikke ileaqehpyhdfkswqkferelrlvknqdiitwmmcrdlmeenkvegldtgtlylkdirp nvqeqgslnvlnrvkpmrlpvvvyradsrghvhkeaplatvyieerntkllkqgnfksfy kdrringlfsfvdtgglameqypiskirveyelakyqtarvcvfeltifieesllsryph lpdesfremleswsdpilakwpelhgkvffliavrnafshnqypmydeavfssirkydps spdaieermginiahriseevkqaketveriiqa |
| Porphyromonas gulae (NZ_JRAJ01000010.1) >WP_039431778.1 (SEQ ID NO: 150) | mteqserpyngtyytledkhfwaafinlarhnayitithidrqlayskaditndqdvlsf kalwknfdndlerksrlrslilkhfsflegaaygkklfeskssgnkssknkeltkkekee lqanalsldnlksilfdflqklkdfrnyyshyrhsesselplfdgnmlqrlynvfdvsvq rvkrdhehndkvdphrhfnhlvrkgkkdryghndnpsfkhhfvdgsegmyteagllffvsl flekrdaiwmqkkirgfkggtetyqqmtnevfcrsrisipkiklesirtddwmlldmine lvrcpkplydrlreddracfrvpvdilpdeddtdgggedpfkntlvrhqdrfpyfalryf dlkkvftslrfhidlgtyhfaiykkmigeqpedrhltrnlygfgriqdfaeehrpeewkr lvrdldyfetgdkpyisqtsphyhiekgkiglrfmpegqhlwpspevgttrtgrskyaqd krltaeaftsvheimpmmfyyflirekyseevsaekvqgrikrviedvyaiydafardei ntlkeldacladkgirrghlpkqmiailsqehkdmeekirkklqemiadtdhrldmldrq tdrkirigrknaglpksgviadwlvrdmmrfqpvakdtsgkpinnskansteyrmiqral alfggekkrltpyfrqmnitggnnphpflhetrweshtnilsfyrsylrarkaflerigr sdrmenrpfllikepktdrqfivagwksefhlprgifteavrdcliemgydevgsyrevg fmakavplyferacedrvqpfydspfnvgnsikpkkgrflskeeraeewergkerfrdle awshsaarriedafagieyaspgnkkkieqllrdislweafesklkvradkinlaklkke ileaqehpyhdfkswqkferelrlvknqdiitwmmcrdlmeenkvegldtgtlylkdirp nvqeqgslnvlnrvkpmrlpvvvyradsrghvhkeeaplatvyieerdtkllkqgnfksf vkdrrlnglfsfvdtgglameqypiskirveyelakyqtarvcvfeltifieesltryp hipdesfrkmleswsdpilakwpelhgkvffliavrnafshnqypmydeavfssirkydp sspdaieermginiahriseevkqaketveriiqv |
| Porphyromonas gulae (NZ_KQ040500.1) >WP_046201018.1 (SEQ ID NO: 151) | mteqserpyngtyytledkhfwaafinlarhnayitithidrqlayskaditndqdvlsf kalwknfdndlerksrlrslilkhfsflegaaygkklfeskssgnkssknkeltkkekee lqanalsldnlksilfdflqklkdfrnyyshyrhsesselplfdgnmlqrlynvfdvsvq rvkrdhehndkvdphrhfnhlvrkgkkdryghndnpsfkhhfvdgsegmyteagllffvsl flekrdaiwmqkkirgfkggtetyqqmtnevfcrsrisipkiklesirtddwmlldmine lvrcpkplydrlrekdrarfrvpvdilpdeddtdgggedpfkntlvrhqdrfpyfalryf dlkkvftslrfhidlgtyhfaiykkmigeqpedrhlttrnlygfgriqdfaeehrpeewkr lvrdldyfetgdkpyisqttphyhiekgkiglrfmpegqhlwpspevgttrtgrskyaqd krltaeaftsvheimpmmfyyflirekyseevsaekvqgrikrviedvyaiydafardei ntlkeldacladkgirrghlpkqmiailsqehkdmeekirkklqemiadtdhrldmldrq tdrkirigrknaglpksgviadwlvrdmmrfqpvakdtsgkpinnskansteyrmiqral alfggekkrltpyfrqmnitggnnphpflhetrweshtnilsfyrsylrarkaflerigr sdrmenrpfllikepktdrqfivagwksefhlprgifteavrdcliemgydevgsyrevg fmakavplyferacedrvqpfydspfnvgnsikpkkgifiskeeraeewergkelfrdle awshsaarriedafagieyaspgnkkkieqllrdislweafeskikvradkinlaklkke ileaqehpyhdfkswqkferelrlvknqdiitwmmcrdlmeenkvegldtgtlylkdirp nvqeqgslnvlnrvkpmrlpvvvyradsrghvhkeeaplatvyieerdtkilkqgnfksf vkdrrlnglfsfvdtgglameqypiskirveyelakyqtarvcvfeltifieesltryp hlpdesfrkmleswsdpilakwpelhgkvffliavrnafshnqypmydeavfssirkydp sspdaieermginiahriseevkqaketveriiqv |
| Porphyromonas gulae (NZ_JRAL01000022.1) >WP_039434803.1 (SEQ ID NO: 152) | mteqserpyngtyytledkhfwaafinlarhnayitithidrqlayskaditndqdvlsf kalwknfdndlerksrlrslilkhfsflegaaygkklfeskssgnkssknkeltkkekee lqanalsldnlksilfdflqklkdfrnyyshyrhsgsselplfdgnmlqrlynvfdvsvq rvkidhehndevdphyhfnhlvrkgkkdryghndnpsfkhhfvdgsegmyteagllffvsl flekrdaiwmqkkirgfkggtetyqqmtnevfcrsrislpklkleslrmddwmlldmlne lvrcpkplydrlreddracfrvpvdilpdeddtdgggedpfkntlvrhqdrfpyfalryf dlkkvftslrfhidlgtyhfaiykkmigeqpedrhltrnlygfgriqdfaeehrpeewkr lvrdldyfetgdkpyisqtsphyhiekgkiglrfmpegqhlwpspevgttrtgrskyaqd krltaeaflsvhelmpmmfyyfllrekyseevsaervqgrikrviedvyavydafardei ntrdeldacladkgirrghlprqmiailsqehkdmeekirkklqemmadtdhrldmldrq tdrkirigrknaglpksgviadwlvrdmmrfqpvakdasgkpinnskansteyrmlqral alfggekerltpyfrqmnitggnnphpflhetrweshtnilsfyrsylrarkaflerigr sdrvenrpflllkepktdrqflvagwkgefhiprgifteavrdcliemghdevasykevg |

TABLE 5-continued

Cas1b

Cas13b orthologs

| | |
|---|---|
| | fmakavplyferacedrvqpfydspfnvgnsikpkkgrflskeeraeewergkerfrdle awsysaarriedafagieyaspgnkkkieqllrdislweafeskikvradrinlakikke ileaqehpyhdfkswqkferelrlvknqdiitwmmcrdlmeenkveqldtgtlylkdirp nvqeqgslnvlnrvkpmrlpvvvyradsrghvhkeeaplatvyieerdtkilkqgnfksf vkdrrlnglfsfvdtgglameqypiskirveyelakyqtarvcvfeltifieeslltryp hipdesfremleswsdpilakwpelhgkvffliavrnafshnqypmydeavfssirkydp sspdaieermginiahriseevkqaketveriiqa |
| *Porphyromonas gulae* (NZ_JRAI01000002.1) >WP_039419792.1 (SEQ ID NO: 153) | mteqserpyngtyytledkhfwaaflnlarhnayitlthidrqlayskaditndqdvlsf kalwknldndlerksrlrslilkhfsflegaaygkklfeskssgnkssknkeltkkekee lqanalsldnlksilfdflqklkdfrnyyshyrhsgsselplfdgnmlqrlynvfdvsyq rvkrdhehndkvdphrhfnhlvrkgkkdryghndnpsfkhhfvdsegmvteagllffvsl flekrdaiwmqkkirgfkggtetyqqmtnevfcrsrislpklkleslrtddwmlldmlne lvrcpkplydrlrekdrarfrvpvdilpdeddtdgggedpfkntivrhqdifpyfalryf dlkkvftslrfhidlgtyhfaiykkvigeqpedrhltrnlygfgriqdfaeehrpeewkr lvrdldyfetgdkpyisqttphyhiekgkiglrfvpegqhlwpspevgttrtgrskyaqd krltaeaflsvhelmpmmfyyfllrekyseevsaekvqgrikrviedvyaiydafardei ntrdeldacladkgirrghlpkqmigilsqehknmeekvrkklqemiadtdhrldmldrq tdrkirigrknaglpksgviadwlvrdmmrfqpvakdtsgkpinnskansteyrmlqral alfggekerltpyfrqmnliggnnphpfldetrweshtnilsfyrsylrarkaflerigr sdrvenrpflllkepktdrqtivagwksefhlprgifteavrdcliemgydevgsyekvg fmakavplyferackdrvqpfydspfnvgnslkpkkgrflskekraeewesgkerfrlak lkkeileaqehpyhdfkswqkferelrlyknqdiitwmmcrdlmeenkveqldtgtlylk dirpnvqeqgslnvlnrvkpmrlpvvvyradsrghvhkeeaplatvyieerdtkllkqgn fksfvkdrrlnglfsfvdtgglameqypisklrveyelakyqtarvcvfeltlrleesll styphlpdesfremleswsdpllakwpelhgkvrlliavrnafshnqypmydeavfssir kydpsspdaieermglniahrlseevkqaketveriiqa |
| *Porphyromonas gulae* (NZ_JRAK01000129.1) >WP_039426176.1 (SEQ ID NO: 154) | mteqserpyngtyytledkhfwaaflnlarhnayitlthidrqlayskaditndqdvlsf kalwknfndnlerksrlrslilkhfsflegaaygkklfeskssgnkssknkeltkkekee lqanalsldnlksilfdflqklkdfrnyyshyrhsgsselplfdgnmlqrlynvfdvsvq rvkrdhehndkvdphyhfnhlvrkgkkdryghndnpsfkhhfvdsegmvteagllffvsl flekrdaiwmqkkirgfkggtgpyeqmtnevfcrsrislpklkleslrtddwmlldmlne lvrcpkplydrlrekdracfrvpvdilpdeddtdgggedpfkntlvrhqdifpyfalryf dlkkvftslrfhidlgtyhfaiykkmigeqpedrhltrnlygfgriqdfaeehrpeewkr lvrdldyfetgdkpyisqttphyhiekgkiglrfmpegqhlwpspevgttrtgrskyaqd krltaeaflsvhelmpmmfyyfllrekyseevsaekvqgrikrvdkdvyaiydafardei ntlkeldacsadkgirrghlpkqmigilsqehknmeekvrkklqemiadtdhrldmldrq tdrkirigrknaglpksgviadwlvrdmmrfqpvakdtsgkpinnskansteyrmlqral alfggekerltpyfrqmnliggnnphpfldetrweshtnilsfyrsylrarkaflerigr sdrvenrpflllkepkndrqtivagwksefhlprgifteavrdcliemgydevgsyekvg fmakavplyferackdrvqpfydspfnvgnslkpkkgrflskekraeewesgkerfrlak lkkeileakehpyhdfkswqkferelrlyknqdiitwmmcrdlmeenkveqldtgtlylk dirtdvheqgslnvlnrvkpmrlpvvvyradsrghvhkeqaplatvyieerdtkllkqgn fksfvkdrrlnglfsfvdtgglameqypisklrveyelakyqtarvcafeqtleleesll tryphlpdenfremleswsdpllgkwpdlhgkvrlliavrnafshnqypmydeavfssir kydpsspdaieermglniahrlseevkqaketveriiqa |
| *Porphyromonas gulae* (NZ_KN294104.1) >WP_039437199.1 (SEQ ID NO: 155) | mteqserpyngtyytledkhfwaaflnlarhnayitlthidrqlayskaditndedilff kgqwknldndlerksrlrslilkhfsflegaaygkkflfesksssgnkssknkeltkkekee lqanalsldnlksilfdflqklkdfrnyyshyrhsgsselplfdgnmlqrlynvfdvsyq rvkrdhehndevdphyhfnhlvrkgkkthyghndnpsfkhhfvdsegmvteagllffvsl flekrdaiwmqkkirgfkggtepyeqmtnevfcrsrislpklkleslrtddwmlldmlne lvrcpkplydrlrekdracfrvpvdilpdeddtdgggedpfkntlvrhqdifpyfalryf dlkkvftslrfhidlgtyhfaiykkmigeqpedrhltrnlygfgriqdfaeehrpeewkr lvrdldyfetgdkpyisqttphyhiekgkiglrfvpegqhlwpspevgttrtgrskyaqd krltaeaflsvhelmpmmfyyfllrekyseevsaekvqgrikrviedvyaiydafardei ntlkeldacladkgirrghlpkqmigilsqerkdmeekvrkklqemiadtdhrldmldrq tdrkirigrknaglpksgviadwlvrdmmrfqpvakdtsgkpinnskansteyrmlqral alfggekerltpyfrqmnliggnnphpflhetrweshtnilsfyrsylrarkaflerigr sdrvencpflllkepktdrqtivagwkgefhlprgifteavrdcliemgydevgsyrevg fmakavplyferacedrvqpfydspfnvgnslkpkkgrflskekraeewesgkerfrlak lkkeileaqehpyhdfkswqkferelrlyknqdiitwmmcrdlmeenkveqldtgtlylk dirpnvqeqgslnvlntvlpmrlpvvvyradsrghvhkeeaplatvyieerdtkllkqgn fksfvkdrrlnglfsfvdtgalameqypisklrveyelakyqtarvcafeqtleleesll tryphlpdesfremleswsdplltkwpelhgkvrlliavrnafshnqypmydeavfssiw kydpsspdaieermglniahrlseevkqaketieriiqa |
| *Porphyromonas gingivalis* TDC60 (NC_015571.1) >WP_013816155.1 (SEQ ID NO: 156) | mteqnekpyngtyytledkhfwaaffnlarhnayitlahidrqlayskaditndedilff kgqwknldndlerkarlrslilkhfsflegaaygkklfesqssgnkssknkeltkkekee lqanalsldnlksilfdflqklkdfrnyyshyrhpesselplfdgnmlqrlynvfdvsyq wkrdhehndlcvdphrhfnhlvrkgkkdrygnndnpffkhhfvdregtvteagllffvsl flekrdaiwmqkkirgfkggtetyqqmtnevfcrsrislpklkleslrtddwmlldmlne lvrcpkslydrlreedrarfrvpvdilsdeedtdgaeedpfkntlvrhqdrfpyfalryf dlkkvftslrfqidlgtyhfaiykknigeqpedrhltmlygfgriqclfaeehrpeewkr lvrdldyfetgdkpyitqttphyhiekgkiglrfvpegqhlwpspevgatrtgrskyaqd |

TABLE 5-continued

| | Cas1b |
|---|---|
| | Cas13b orthologs |
| | krftaeaflsahelmpmmfyyfllrekyseeasaervqgrikridedvyavydafardei<br>ntrdeldacladkgirrghlprqmigilsqehkdmeekirkklqemmadtdhrldmldrq<br>tdrkirigrknaglpksgviadwlvrdmmrfqpvakdtsgkpinnskansteyrmlqral<br>alfggekerltpyfrqmnitggnnphpflhetrweshtnilsfyrsylkarkaflqsigr<br>sdrvenhrflllkepktdrqtivagwkgefhlprgifteavrdcliemgldevgsykevg<br>fmakavplyferackdwvqpfynypfnvgnslkpkkgrfiskekraeewesgkerfrlak<br>lkkeileakehpyldfkswqkferelrlyknqdittwmicgdlmeenkvegldtgtlylk<br>dirtdvqeqgslnvlnrvkpmrlpvvvyradsrghvhkeqaplatvyieerdtkllkqgn<br>fksfvkdrrlnglfsfvdtgalameqypisklrveyelakyqtarvcafeqtleleesll<br>trcphlpdknfrkmleswsdplldkwpdlhrkvrlliavrnafshnqypmydeavfssir<br>kydpsfpdaieermglniahrlseevkqaketveriiqa |
| *Porphyromonas gingivalis* ATCC 33277<br>(NC_010729.1)<br>>WP_012458414.1<br>(SEQ ID NO: 157) | mteqnerpyngtyytledkhfwaaffnlarhnayitlahidrqlayskaditndedilff<br>kgqwknldndlerkarlrslilkhfsflegaaygkklfesqssgnksskkkeltkkekee<br>lqanalsldnlksilfdflqklkdfinyyshyrhpesselplfdgnmlqrlynvfdvsyq<br>rvkrdhehndkvdphrhfnhlvrkgkkdrygnndnpffkhhfvdreekvteaglllfffvsl<br>flekrdaiwmqkkirgfkggtetyqqmtnevfcrsrislpklkleslrtddwmlldmlne<br>lvrcpkslydrlreedrarfrvpvdilsdeddtdgteedpfkntlvrhqdrfpyfalryf<br>dlkkvftslrfhidlgtyhfaiykknigeqpedrhltrnlygfgriqdfaeehipeewkr<br>lvrdldyfetgdkpyitqttphyhiekgkiglrfvpeggqhlwpspevgatrtgrskyaqd<br>krltaeaflsvhelmpmmfyyfllrekysdeasaervqgrikrvdedvyavydafargei<br>ntrdeldacladkgirrghlprqmigilsqehkdmeekvrkklqemivdtdhrldmldrq<br>tdrkirigrknaglpksgviadwlvrdmmrfqpvakdtsgkpinnskansteyrmlqral<br>alfggekerltpyfrqmnliggnnphpflhetrweshtnilsfyrsylkarkaflqsigr<br>sdrvenhrflllkepktdrqtivagwkgefhlprgifteavrdcliemgldevgsykevg<br>fmakavplyferackdrvqpfydypfnvgnslkpkkgiflskekraeewesgkelfrlak<br>lkkeileakehpyldfkswqkferelrlyknqdittwmicrdlmeenkvegldtgtlylk<br>dirtdvqeqgnlnvlnrvkpmrlpvvvyradsrghvhkeqaplatvyieerdtkllkqgn<br>fksfvkdrrlnglfsfvdtgalameqypisklrveyelakyqtarvcafeqtleleesll<br>tryphlpdknfrkmleswsdplldkwpdlhgnvrlliavrnafshnqypmydeavfssir<br>kydpsspdaieermglniahrlseevkqakemaeriiqa |
| *Porphyromonas gingivalis* A7 A1-28<br>(NZ_CP013131.1)<br>>WP_058019250.1<br>(SEQ ID NO: 158) | mteqnekpyngtyytlkdkhfwaaffnlarhnayitlthidrqlayskaditndedilff<br>kgqwknldndlerkarlrslilkhfsflegaaygkklfesqssgnksskkkeltkkekee<br>lqanalsldnlksilfdflqklkdfinyyshyrhpesselpmfdgnmlqrlynvfdvsyq<br>rvkrdhehndkvdphrhfnhlvrkgkkdrcgnndnpffkhhfvdregkvteaglllfffvsl<br>flekrdaiwmqkkirgfkggtetyqqmtnevfcrsrislpklkleslrtddwmlldmlne<br>lvrcpkslydrlreedracfrvpvdilsdeddtdgaeedpfkntlvrhqdrfpyfalryf<br>dlkkvftslrfhidlgtyhfaiykknigeqpedrhltrnlygfgriqdfaeehrpeewkr<br>lvrdldcfetgdkpyitqttphyhiekgkiglrfvpeggqhlwpspevgatrtgrskyaqd<br>krftaeaflsvhelmpmmfyyfllrekyseevsaervqgrikrvdedvyavydafardei<br>ntrdeldacladkgirrghlprqmiailsqkhkdmeekvrkklqemiadtdhrldmldrq<br>tdrkirigrknaglpksgviadwlvrdmmrfqpvakdtsgkpinnskansteyrmlqral<br>alfggekerltpyfrqmnliggnnphpflhetrweshtnilsfyrsylkarkaflqsigr<br>sdrvenhrflllkepktdrqtivagwkgefhlprgifteavrdcliemgldevgsykevg<br>fmakavplyferackdrvqpfydypfnvgnslkpkkgiflskekraeewesgkelfrdle<br>awshsaarriedafagienasrenkkkieqllqdlslwetfesklkvkadkiniaklkke<br>ileakehpyldfkswqkferelrlyknqdiftwmmcrdlmeenkvegldtgtlylkdirt<br>dvqeqgslnylnhvkpmrlpvvvyradsrghvhkeqaplatvyieerdtkllkqgnfksf<br>vkdrrlnglfsfvdtgalameqypisklrveyelakyqtarvcafeqtleleeslltryp<br>hlpdenfrkmleswsdplldkwpdlhrkvriliavrnafshnqypmydeavfssirkydp<br>sspdaieermglniahrlseevkqakemaeriiqa |
| *Porphyromonas gingivalis* JCVI SC001<br>(APMB01000175.1)<br>>EOA10535.1<br>(SEQ ID NO: 159) | mteqnekpyngtyytledlchfwaaffnlarhnayithhidrqlayskaditndedilff<br>kgqwknldndlerkarlrslilkhfsflegaaygkklfesqssgnksskkkeltkkekee<br>lqanalsldnlksilfdflqklkdfinyyshyrhpesselplfdgnmlqrlynvfdvsyq<br>rvkrdhehndkvdphrhfnhlvrkgkkdrcgnndnpffkhhfvdreekvteaglllfffvsl<br>flekrdaiwmqkkirgfkggtetyqqmtnevfcrsrislpklkleslrtddwmlldmlne<br>lvrcpkslydrlreedrarfrvpvdilsdeddtdgteedpfkntlvrhqdrfpyfalryf<br>dlkkvftslrfhidlgtyhfaiykknigeqpedrhltrnlygfgriqdfaeehipeewkr<br>lvrdldyfetgdkpyitqttphyhiekgkiglrfvpeggqllwpspevgatrtgrskyaqd<br>krftaeaflsvhelmpmmfyyfllrekyseeasaervqgrikrviedvyavydafargei<br>dtldrldacladkgirrghlprqmiailsqehkdmeekvrkklqemiadtdhrldmldrq<br>tdrkirigrknaglpksgviadwlvrdmmrfqpvakdtsgkpinnskansteyrmlqral<br>alfggekerltpyfrqmnliggnnphpflhetrweshtnilsfyrsylkarkaflqsigr<br>sdrvenhrfillkepktdrqtivagwkgefhlprgifteavrdcliemgldevgsykevg<br>fmakavplyferackdrvqpfydypfnvgnslkpkkgrflskekraeewesgkerfrdle<br>awshsaarriedafagienasrenkkkieqllqdlslwetfesklkvkadkiniaklkke<br>ileakehpyldfkswqkferelrlyknqdittwmmcrdlmeenkvegldtgtlylkdirt<br>dvheqgslnvlnrvkpmrlpvvvyradsrghvhkeqaplatvyieerdtkllkqgnfksf<br>vkdrrlnglfsfvdtgalameqypisklrveyelakyqtarvcafeqtleleeslltryp<br>hlpdknfrkmleswsdplldkwpdlhgnvrlliavrnafshnqypmydetlfssirkydp<br>sspdaieermglniahrlseevkqakemveriiqa |
| *Porphyromonas gingivalis* W50 | mteqnekpyngtyytledkhfwaaffnlarhnayitlahidrqlayskaditndedilff<br>kgqwknldndlerkarlrslilkhfsflegaaygkklfesqssgnksskkkeltkkekee |

TABLE 5-continued

| Cas1b |
| --- |

| Cas13b orthologs | |
| --- | --- |
| (NZ_AJZS01000051.1)<br>>WP_005874195.1<br>(SEQ ID NO: 160) | lqanalsldnlksilfdflqklkdfrnyyshyrhpesselplfdgnmlqrlynvfdvsvq<br>nlrdhehndkvdphrhfnhlvrkgkkdkygnndnpfflchhfvdreekvteagllffvsl<br>flekrdaiwmqkkirgfkggteayqqmtnevfcrsrislpklkleslrtddwmlldmlne<br>lvrcpkslydrlreedrarflipvdilsdeddtdgteedpfkntivrhqthfpyfaltyf<br>dlklvftslrfhidlgtyhfaiykknigeqpedrhltrnlygfgriqdfaeehrpeewkr<br>lvrdldyfetgdkpyitqttphyhiekgkiglrfvpegqllwpspevgatrtgrskyaqd<br>krftaeaflsvhelmpmmfyyfllrekyseeasaekvqgrikrvdedvyavydafardei<br>ntrdeldacladkgirrghlprqmiailsqehkdmeekvrkklqemiadtdhrldmldrq<br>tdrkirigrknaglpksgviadwlvrdmmrfqpvakdtsgkpinnskansteyrmlqral<br>alfggekerltpyfrqmnlliggnnphpflhetrweshtnilsfyrsylkarkaflqsigr<br>sdreenhrfilllkepktdrqtivagwksefhlprgifteavrdcliemgydevgsykevg<br>fmakavplyferackdrvqpfydypfnvgnslkpkkgrflskekraeewesgkerfrdle<br>awshsaarriedafvgieyaswenkkkieqllqdlslwetfesklkvkadkiniaklkke<br>ileakehpyhdfkswqkferelrlyknqdiitwmmcrdlmeenkvegldtgtlylkdirt<br>dvqeqgslnvlnhvkpmrlpvvvyradsrghvhkeeaplatvyieerdtkllkqgnfksf<br>vkdrringlfsfvdtgalameqypisklrveyelakyqtarvcafeqtleleesllryp<br>hlpdesfremleswsdpildkwpdlqrevrlliavmafshnqypmydetifssirkydp<br>ssldaieermglniahrlseevklakemveriiqa |
| Porphyromonas<br>gingivalis<br>(NZ_CP011995.1)<br>>WP_052912312.1<br>(SEQ ID NO: 161) | mteqnekpyngtyytledkhfwaaffnlarhnayitlahidrqlayskaditndedilff<br>kgqwknldndlerkarlrslilkhfsflegaaygkklfesqssgnksskkkeltkkekee<br>lqanalsldnlksilfdflqklkdfrnyyshyrhpesselplfdgnmlqrlynvfdvsyq<br>nlrdhehndkvdphrhfnhlvrkgkkdkygnndnpfflchhfvdreekvteagllffvsl<br>flekrdaiwmqkkirgfkggteayqqmtnevfcrsrislpklklestrtddwmlldmlne<br>lvrcpktlydrlreedrarfrvpvdilsdeddtdgteedpfkntivrhqthfpyfallyf<br>dlklvftslrfhidlgtyhfaiykknigeqpedrhltrnlygfgriqdfaeehrpeewkr<br>lvrdldyfetgdkpyitqttphyhiekgkiglrfvpegqllwpspevgatrtgrskyaqd<br>kiftaeaftsvhelmpmmfyyfllrekyseeasaekvqgrikrviedvyavydafardei<br>ntrdeldacladkgirrghlprqmiailsqehkdmeekvrkklqemiadtdhrldmldrq<br>tdrkirigrknaglpksgviadwlvrdmmrfqpvakdtsgkpinnskansteyrmlqral<br>alfggekerltpyfrqmnlliggnnphpflhetrweshtnilsfyrsylkarkaflqsigr<br>sdreenhrfilllkepktdrqtivagwksefhlprgifteavrdcliemgydevgsykevg<br>fmakavplyferackdrvqpfydypfnvgnslkpkkgrflskekraeewesgkerfrdle<br>awshsaarriedafvgieyaswenkkkieqllqdlslwetfesklkvkadkiniaklkke<br>ileakehpyhdfkswqkferelrlyknqdiitwmmcrdlmeenkvegldtgtlylkdirt<br>dvqeqgslnvlnhvkpmrlpvvvyradsrghvhkeeaplatvyieerdtkllkqgnfksf<br>vkdrrlnglfsfvdtgalameqypisklrveyelakyqtarvcafeqtleleesllryp<br>hlpdesfremleswsdplldkwpdlqrevrlliavrnafshnqypmydetifssirkydp<br>ssldaieermglniahrlseevklakemveriiqa |
| Porphyromonas<br>gingivalis AJVV4<br>(NZ_CP011996.1)<br>>WP_053444417.1<br>(SEQ ID NO: 162) | mteqnekpyngtyytledkhfwaaflnlarhnayitlahidrqlayskaditndedilff<br>kgqwknldndlerkarlrslilkhfsflegaaygkklfesqssgnksskkkelskkekee<br>lqanalsldnlksilfdflqklkdfrnyyshyrhpesselplfdgnmlqrlynvfdvsyq<br>nlrdhehndkvdphrhfnhlvrkgkkdkygnndnpfflchhfvdregtvteagllffvsl<br>flekrdaiwmqkkirgfkggteayqqmtnevfcrsrislpklklestrtddwmlldmlne<br>lvrcpkslydrlreedrarflipvdilsdeddtdgteedpfkntivrhqthfpyfaltyf<br>dlklvftslrfhidlgtyhfaiykknigeqpedrhltrnlygfgriqdfaeehrpeewkr<br>lvrdldyfetgdkpyitqttphyhiekgkiglrfvpegqhlwpspevgatrtgrskyaqd<br>krltaeaftsvhelmpmmfyyfllrekyseevsaekvqgrikrviedvyavydafardei<br>ntrdeldacladkgirrghlprqmiailsqehkdmeekvrkklqemiadtdhrldmldrq<br>tdrkirigrknaglpksgvvadwlvrdmmrfqpvakdtsgkpinnskansteyrmlqral<br>alfggekerltpyfrqmnlliggnnphpflhetrweshtnilsfyrsylearkaflqsigr<br>sdrvenhrfilllkepktdrqtivagwkefhlprgifteavrdcliemgydevgsykevg<br>fmakavplyferaskdrvqpfydypfnvgnslkpkkgrflskekraeewesgkerfrlak<br>lkkeileakehpyhdtkswqkferelrlyknqdittwmmcrdlmeenkvegldtgtlylk<br>dirtdvqeqgslnvlnrvkpmrlpvvvyradsrgtwhkeqaplatvyieerdtkllkqgn<br>fksfvkdrrlnglfsfvdtgalameqypisklrveyelakyqtarvcafeqtleleesll<br>tryphlpdknfrkmleswsdpildkwpdlhgnvrlliavrnafshnqypmydetlfssir<br>kydpsspdaieermglniahrlseevkqakemveriiqa |
| Porphyromonas<br>gingivalis<br>(NZ_CP007756.1)<br>>WP_039417390.1<br>(SEQ ID NO: 163) | mteqnerpyngtyytledkhfwaaffnlarhnayitlahidrqlayskaditndedilff<br>kgqwknldndlerkarlrslilkhfsflegaaygkklfesqssgnksskkkeltkkekee<br>lqanalsldnlksilfdflqklkdfinyyshyrhpesselplfdgnmlqrlynvfdvsyq<br>mkrdhehndlcvdphrhfnhlvrkgkkdrygnndnpftkhhfvdregtvteagllffvsl<br>flekrdaiwmqkkirgfkggteayqqmtnevfcrsrislpklklestrtddwmlldmlne<br>lvrcpkslydrlreedrarfrvpidilsdeddtdgteedpfkatlvrhqdrfpyfalryf<br>dlklvftslrfhidlgtyhfaiykknigeqpedrhltrnlygfgriqdfaeehipeewkr<br>lvrdldyfetgdkpyitqttphyhiekgkiglrfvpegqhlwpspevgatrtgrskyaqd<br>krltaeaftsvhelmpmmfyyfllrekyseevsaekvqgrikrviedvyavydafargei<br>dtlrdlacladkgirrghlprqmiailsqehkdmeekvrkklqemiadtdhrldmldrq<br>tdrkirigrknaglpksgviadwlvrdmmrfqpvakdtsgkpinnskansteyrmlqral<br>alfggekerltpyfrqmnlliggnnphpflhetrweshtnilsfyrsylkarkaflqsigr<br>sdreenhrfilllkepktdrqtivagwksefhlprgifteavrdcliemgydevgsykevg<br>fmakavplyferackdrvqpfydypfnvgnslkpkkgrflskekraeewesgkerfrlak<br>lkkeileakehpyldfkswqkferelrlyknqdiftwmmcrdlmeenkvegldtgtlylk<br>dirtdvheqgslnvlnrvkpmrlpvvvyradsrghvhkeqaplatvyieerdtkllkqgn |

TABLE 5-continued

| Cas1b |
|---|
| Cas13b orthologs |

| | |
|---|---|
| | fksfvkdrrlnglfsfvdtgalameqypisklrveyelakyqtarvcafeqtleleesll<br>tryphlpdknfrkmleswsdpildkwpdthrkvrlliavrnafshnqypmydeavfssir<br>kydpsspdaieermglniahrlseevkqakemaeriiqv |
| *Porphyromonas gingivalis* (NZ_LOEL01000001.1) >WP_061156470.1 (SEQ ID NO: 164) | mteqnerpyngtyyytledkhfwaaffnlarhnayitlthidrqlayskaditndedilff<br>kgqwknldndlerkarlrslilkhfsflegaaygkklfenkssgnksskkkeltkkekee<br>lqanalsldnlksilfdflqklkdfinyyshyrhpesselplfdgnmlqrlynvfdvsvq<br>mkrdhehndlcvdphrhfnhlvrkgkkdrcgnndnpftkhhfvdregkvteagllffvsl<br>flekrdaiwmqkkirgfkggteayqqmtnevfcrsrislpklklestrtddwmlldmlne<br>lvrcpkslydrlreedrarfrvmvdilsdeddtdgteedpfkativrhqdrfpyfalryf<br>dlklvftslrfhidlgtyhfaiykknigeqpedrhltrnlygfgriqdfaeehipeewkr<br>lvrdldyfetgdkpyitqttphyhiekgkiglrfvpeggqhlwpspevgatrtgrskyaqd<br>krltaeaftsvhelmpmmfyyfllrekyseevsaekvqgrikrviedvyavydafargei<br>dtldrldacladkgirrghlprqmiailsqehkdmeekvrkklqemiadtdhrldmldrq<br>tdrkirigrknaglpksgviadwlvrdmmrfqpvakdtsgkpinnskansteyrmlqral<br>alfggekerltpyfrqmnliggnnphpflhetrweshtnilsfyrsylkarkaflqsigr<br>sdreenhrfillkeptkdrqtivagwksefhlprgifteavrdcliemgydevgsykevg<br>fmakavplyferackdrvqpfydypfnvgnslkpkkgrflskekraeewesgkerfrlak<br>lkkeileakehpyldfkswqkferelrlyknqdiftwmmcrdlmeenkvegldtgtlylk<br>dirtevqeqgslnvlnrvkpmrlpvvvyradsrghvhkeqaplatvyieerdtkllkqgn<br>fksfvkdrrlnglfsfvdtgglameqypisklrveyelakyqtarvcafeqtleleesll<br>trcphlpdknfrkmleswsdpildkwpdlqrevwlliavrnafshnqypmydeavfssir<br>kydpsspdaieermglniahrlseevkqakemaeriiqa |

TABLE 6

| Cas13c |
|---|
| Cas13c orthologs |

| | |
|---|---|
| *Fusobacterium necrophorum* subsp. funduliforme ATCC 51357 contig00003 WP_005959231.1 (SEQ ID NO: 165) | MEKFRRQNRNSIIKIIISNYDTKGIKELKVRYRKQAQLDTFIIKTEIVNNDIFIKSIIEKAREKYRYSF<br>LEDGEEKYHFKNKSSVEIVKKDIFSQTPDNMIRNYKITLKISEKNPRVVEAEIEDLMNSTILKDGR<br>RSARREKSMTERKLIEEKVAKNYSLLANCPMEEVDSIKIYKIKRELTYRSNMLLYFASINSFLCEG<br>IKGKDNETEEIWHLKDNDVRKEKVRENFKNKLIQSTENYNSSLKNQIEEKEKLLRKEFKKGAFY<br>RTIIKKLQQERIKELSEKSLTEDCEKIIKLYSKLRHSLMHYDYQYFENLFENKKNDDLMKDLNLD<br>LEKSLPLIRKMKLNNKVNYLEDGDTLFVLQKTKKAKTLYQIYDALCEQKNGENKFINDDFFVSDG<br>EENTVEKQIIINEKFQSEMEFLEKRISESEKKNEKLKKKLDSMKAHFRNINSEDTKEAYFWDIHSS<br>RNYKTKYNERKNLVNEYTELLGSSKEKKLLREEITKINRQLLKLKQEMEEITKKNSLERLEYKM<br>KIAFGELFCEEDGNISKEKDEFDASNQEKIIQYHKNGEKYLTSFLKEEEKEKENLEKMQKIIQKTE<br>EEDWLLPETKNNLEKFYLLTYLLLPYELKGDFLGFVKKHYYDIKNVDFIDENQNNIQVSQTVEK<br>QEDYFYHKIRLFEKNTKKYEIVKYSIVPNEKLKQYFEDLGIDIKYLTVEQKSEVSEEKNKKVSLK<br>NNGMFNKTILLFVFKYYQIAFKLENDIELYSLEFLREKSGKPLEIFRKELESKMKDGYLNEGQLLY<br>VVYEVLVKNKDLDKILSKKIDYRKDKSFSPEIAYLRNFLSHLNYSKFLDNFMKINTNKSDENKEV<br>LIPSIKIQKMIQFIEKCNLQNQIDFDFNEVNDFYMRKEKMFFIQLKQIFPDINSTEKQKMNEKEEIL<br>RNRYHLTDKKNEQIKDEHEAQSQLYEKILSLQKIYSSDKNNFYGRLKEEKLLFLEKQGKKKLSM<br>EEIKDKIAGDISDLLGILKKEITRDIKDKLTEKFRYCEEKLLNLSFYNHQDKKKEESIRVFLIRDKN<br>SDNEKFESILDDGSNKIFISKNGKEITIQCCDKVLETLIIEKNTLKISSNGKIISLIPHYSYSIDVKY |
| *Fusobacterium necrophorum* DJ-2 contig0065, whole genome shotgun sequence WP_035906563.1 WP_062627846.1 (SEQ ID NO: 166) | MEKERRQNRSSIIKIIISNYDTKGIKELKVRYRKQAQLDTFIIKTEIVNNDIFIKSIIEKAREKYRYSF<br>LEDGEEKYHFKNKSSVEIVKKDIFSQTPDNMIRNYKITLKISEKNPRVVEAEIEDLMNSTILKDGR<br>RSARREKSMTERKLIEEKVAENYSLLANCPMEEVDSIKIYMKRELTYRSNMLLYFASINSFLCEG<br>IKGKDNETEEIWHLKDNDVRKEKVKENFKNKLIQSTENYNSSLKNQIEEKEKLLRKESKKGAFY<br>RTIIKKLQQERIKELSEKSLTEDCEKIIKLYSELRHPLMHYDYQYFENLFENKENSELKTKLNNLDIF<br>KSLPLVRKMKLNNKVNYLEDNDTLEVLQKTKKAKTLYQIYDALCEQKNGENKFINDDFFVSDGE<br>ENTVEKQIIINEKFQSEIEFLEKRISESEKKNEKLKKKLDSMKAHFRNINSEDTKEAYFWDIFISSRN<br>YKTKYNERKNLVNEYTELLGSSKEKKLLREEITKINRQLLKLKQEMEEITKKNSLERLEYKMKM<br>AFGELFCEEDGNISRFKDEFDASNQEKIIQYHKNGEKYLTYFLKEEEKEKENLKKLQETIQKTGEE<br>NVVLLPQNKNNLEKFYLLTYLLLPYELKGDFLGFVKKHYYDIKNVDEMDENQSSKIIESKEDDFY<br>HKIRLFEKNTKKYEIVKYSIVPDKKLKQYFKDLGMTKYLILDQKSEVSGEKNKKVSLKNNGMF<br>NKTILLFVFKYYQIAFKLENDIELYSLEFLREKSGKPFEVELKELKDKMIGKQLNEGQLLYVVYE<br>VLVKNKDLSEILSERIDYRKDMCFSAEIADLRNELSHLNYSKFLDNMCKINTNKSDENKEVLIPSI<br>KIQKMIKFIEECNLQSQIDFDFNEVNDFYMRKEKMFFIQLKQIFPDINSTEKQKMNEKEEILRNRY<br>HLTDKKNEQIKDEHEAQSQLYEKILSLQKIYSSDKNNFYGRLKEEKLLFLEKQEKKKLSMEEIKD<br>KIAGDISDLLGILKKEITRDIKDKLTEKFRYCEEKLLNLSFYNHQDKKKEESIRVFIIRDKNSDNEK<br>FESILDDGSNKIFISKNGKEITIQCCDKVLETLIIEKNTLKISSNGKIISLIPHYSYSIDVKY |
| *Fusobacterium necrophorum* BFTR-1 contig0068 WP_035935671.1 (SEQ ID NO: 167) | MKVRYRKQAQLDTFIIKTEIVNNDIFIKSIIEKAREKYRYSFLEDGEEKYHEKNKSSVEIVKNDIFS<br>QTPDNIVIIRNYKITLKISEKNPRVVEAEIEDLMNSTILKDGRRSARREKSMTERKLIEEKVAENYSL<br>LANCPIEEVDSIKIYKIKRFLTYRSNMLLYFASINSFLCEGIKGKDNETEEIVVHLKDNDVRKEKVK<br>ENFKNKLIQSTENYNSSLKNQIEEKEKLSSKEFKKGAFYRTIIKKLQQERIKELSEKSLTEDCEKII<br>KLYSELRHPLMHYDYQYFENLFENKENSELKTKNLNLDIPKSLPLVRKMKLNNKVNYLEDNDTL<br>FVLQKTKKAKTLYQIYDALCEQKNGENKFINDDFFVSDGEENTVEKQIIINEKFQSEMEFLEKRISES<br>EKKNEKLKKKLDSMKAHERNINSEDTKEAYFWDIFISSRNYKTKYNERKNLVNEYTKLLGSSKE<br>KKLLREEITKINRQLLKLKQEMEEITKKNSLERLEYKMKIAFGELFCEEDGNISKEKDEFDASNQE |

TABLE 6-continued

Cas13c
Cas13c orthologs

| | |
|---|---|
| | KIIQYHKNGEKYLTSFLKEEEKEKENLEKMQKIIQKTEEEDWLLPETKNNLEKFYLLTYLLLPYE<br>LKGDFLGFVKKHYYDIKNVDEMDENQNNIQVSQTVEKQEDYFYHKIRLFEKNTKKYEIVKYSIV<br>PNEKLKQYFEDLGIDIKYLTGSVESGEKWLGENLGIDIKYLTVEQKSEVSEEKNKKVSLKNNGM<br>FNKTILLFVFKYYQIAFKLENDIELYSLFFLREKSEKPFEVFLEELKDKMIGKQLNEGQLLYVVYE<br>VLVKNKDLDKILSKKIDYRKDKSFSPEIAYLRNFLSHLNYSKFLDNFMKINTNKSDENKEVLIPSI<br>KIQKMIQFIEKCNLQNQIDEDFNEVNDFYMRKEKMFFIQLKQIFPDINSTEKQKKSEKEEILRKRY<br>HLINKKNEQIKDEHEAQSQLYEKILSLQKIFSCDKNNFYRRLKEEKLLFLEKQGKKKISMKEIKD<br>KIASDISDLLGILKKEITRDIKDKLTEKFRYCEEKLLNISFYNHQDKKKEEGIRVFLIRDKNSDNFK<br>FESILDDGSNKIFISKNGKEITIQCCDKVLETLMIEKNTLKISSNGKIISLIPHYSYSIDVKY |
| *Fusobacterium*<br>*necrophorum* subsp.<br>funduliforme<br>1_1_36S cont1.14<br>EHO19081.1<br>(SEQ ID NO: 168) | MTEKKSIIFKNKSSVEIVKKDIFSQTPDNMIRNYKITLKISEKNPRVVEAEIEDLMNSTILKDGRRS<br>ARREKSMTERKLIEEKVAENYSLLANCPMEEVDSIKIYKIKRELTYRSNMLLYFASINSFLCEGIK<br>GIGDNETEEIVVHLKDNDVRKEKVKENEKNKLIQSTENYNSSLKNQIEEKEKLLRKESKKGAFYRT<br>IIKKLQQERIKELSEKSLTEDCEKIIKLYSELRHPLMHYDYQYFENLFENKENSELTKNLNLDIFKS<br>LPLVRKMKLNNKVNYLEDNDTLFVLQKTKKAKTLYQIYDALCEQKNGENKFINDFFVSDGEEN<br>TVFKQIINEKFQSEMEFLEKRISESEKKNEKLKKKFDSMKAHFPHNINSEDTKEAYFWDIHSSSNY<br>KTKYNERKNLVNEYTELLGSSKEKKLLREEITQINRKLLKLKQEMEEITKKNSLERLEYKMKIAF<br>GELFCEEDGNISKFKDEFDASNQEKIIQYHKNGEKYLTYFLKEEEKEKFNLEKMQKIIQKTEEED<br>WLLPETKNNLEKFYLLTYLLLPYELKGDFLGFVKKHYYDIKNVDEMDENQNNIQVSQTVEKQE<br>DYFYHKIRLFEKNTKKYEIVKYSIVPNEKLKQYFEDLGIDIKYLTGSVESGEKWLGENLGIDIKYL<br>TVEQKSEVSEEKIKKFL |
| *Fusobacterium*<br>*perfoetens* ATCC<br>29250<br>T364DRAFT_<br>scaffold00009.9_C<br>WP_027128616.1<br>(SEQ ID NO: 169) | MGKPNRSSIIKIIISNYDNKGIKEVKVRYNKQAQLDTFLIKSELKDGKFILYSIVDKAREKYRYSFE<br>IDKTNINKNEILIIKKDIYSNKEDKVIRKYILSFEVSEKNDRTIVTKIKDCLETQKKEKFERENTRRL<br>ISETERKLLSEETQKTYSKIACCSPEDIDSVKIYKIKRYLAYRSNMLLFFSLINDIFVKGVVKDNGE<br>EVGEIVVRIIDSKEIDEKKTYDLLVENFPKKRMSQEFINYKQSIENKIEKNTNKIKEIEQKLKKEKYK<br>KEINRLKKQLIELNRENDLLEKDKIELSDEEIREDIEKILKIYSDLRHKLMHYNYQYFENLFENKKI<br>SKEKNEDVNLTELLDLNLFRYLPLVRQLKLENKTYNYLEKEDKITVLGVSDSAIKYYSYNFLCE<br>QKNGENNFINSFFSNDGEENKSEKEKINLSLEKEIEIMEKETNEKIKEINKNELQLMKEQKELGTA<br>YVLDIHSLNDYKISHNERNKNVKLQNDIVINGNRDKNALDKINKKLVELKIKMDKITKRNSILRL<br>KYKLQVAYGELMEEYKGNIKKEKDEFDISKEKIKSYKSKGEKYLEVKSEKKYITKILNSIEDIHNI<br>TWLKNQEENNLEKEYVLTYILLPFEFRGDFLGFVKKHYYDIKNVEFLDENNDRLTPEQLEKMKN<br>DSFFNKIRLFEKNSKKYDILKESILTSERIGKYFSLLNTGAKYFEYGGEENRGIFNKNIIIPIFKYYQI<br>VLKLYNDVELAMLLTLSESDEKDINKIKELVTLKEKVSPKKIDYEKKYKFSVLLDCFNRIINLGK<br>KDFLASEEVKEVAKTFTNLAYLRNKICHLNYSKFIDDLLTIDTNKSTTDSEGKLLINDRIRKLIKFI<br>RENNQKMNISIDYNYINDYYMKKEKFIFGQRKQAKTIIDSGKKANKRNKAEEELLKMYRVKKENI<br>NLIYELSKKLNELTKSELFLLDKKLLKDIDFTDVKIKNKSFFELKNDVKEVANIKQALQKHSSELI<br>GIYKKEVIMAIKRSIVSKLIYDEEKVLSIIIYDKTNKKYEDFLLEIRRERDINKFQFLIDEKKEKLGY<br>EKIIETKEKKKVVVKIQNNSELVSEPRIIKNKDKKKAKTPEEISKLGILDLTNHYCFNLKITL |
| *Fusobacterium*<br>*ulcerans* ATCC<br>49185 cont2.38<br>WP_106878539.1<br>WP_040490876.1<br>(SEQ ID NO: 170) | MENKGNNKKIDFDENYNILVAQIKEYFTKEIENYNNRIDNIIDKKELLKYSEKKEESEKNKKLEE<br>LNKLKSQKLKILTDEEIKADVIKIIKIFSDLRHSLMHYEYKYFENLFENKKNEELAELLNLNLEKN<br>LTLLRQMKIENKTNYLEGREEFNIIGKNIKAKEVLGHYNLLAEQKNGENNFINSFEVQDGTENLE<br>FKKLIDEHEVNAKKRLERNIKSSKKLEKELEKMEQHYQRLNCAYVWDIHTSTTYKKLYNKRKS<br>LIEEYNKQINEIKDKEVITAINVELLRIKKEMEEITKSNSLERLKYKMQIAYAFLEIEFGGNIAKEK<br>DEEDCSKMEEVQKYLKKGVKYLKYYDKEAQKNYEFPFEEIFENKDTHNEEWLENTSENNLEK<br>FYILTYLLLPMEFKGDFLGFVKKHYYDIKNVDFTDESEKELSQVQLDKMIGDSFEHKIRLFEKNT<br>KRYEIIKYSILTSDEIKRYFRLLELDVPYFEYEKGTDEIGIFNKNIILTIFKYYQIIFRLYNDLEIHGLF<br>NISSDLDKILRDLKSYGNKNINFREFLYVIKQNNNSSTEEEYRKIVVENLEAKYLRLHLLTPEKEEI<br>KTKTKEELEKLNEISNLRNGICHLNYKEIIEEILKTEISEKNKEATLNEKIRKVINFIKENELDKVEL<br>GENFINDFFMKKEQFMFGQIKQVKEGNSDSITTERERKEKNNKKLKETYELNCDNLSEFYETSN<br>NLRERANSSSLLEDSAFLKKIGLYKVKNNKVNSKVKDEEKRIENIKRKLLKDSSDIMGMYKAEV<br>VKKLKEKLILIFKHDEEKRIYVTVYDTSKAVPENISKEILVKRNNSKEEYFFEDNNKKYVTEYYT<br>LEITETNELKVIPAKKLEGKEEKTEKNKENKLMLNNHYCFNVKIIY |
| *Anaerosalibacter* sp.<br>ND1 genome<br>assembly<br>*Anaerosalibacter*<br>*massiliensis* ND1<br>WP_042678931.1<br>(SEQ ID NO: 171) | MKSGRREKAKSNKSSIVRVIISNEDDKQVKEIKVLYTKQGGIDVIKEKSTEKDEKGRMKENEDCA<br>YNRLEEEEENSEGGKGKQSFEVTTNEDLTELHVTKRHKTTGEIIKDYTIQGKYTPIKQDRTKVTV<br>SITDNKDHFDSNDLGDKIRLSRSLTQYTNRILLDADVMKNYREIVCSDSEKVDETINIDSQEIYKI<br>NRELSYRSNMHYYQMINNPLLHYGEEDKGGNDSINLINEIWKYENKKNDEKEKIIERSYKSIEK<br>SINQYILNHNTEVESGDKEKKIDISEERIKEDLKKTFILFSRLRHYMVHYNYKEYENLYSGKNFITY<br>NKDKSKSRRESELLDLNIFKELSKIKLVKNRAVSNYLDKKTTIFIVLNKNINAIKLLDIYRDICETK<br>NGFNNFINNMMTISGEEDKEYKEMVTKHFNEMMNKLSIYLENPFKKHSDFKTNNKKKETYNLLK<br>QELDEQKKLRLWFNAPYVYDNSSKKYKELYVERKKYVDIHSKLIEAGINNDNKKKLNEINVKL<br>CELNTEMKEMTKLNSKYRLQYKLQLAFGFILEEFNLDIDKEVSAFDKDNNLTISKFMEKRETYLS<br>KSLDRRDNRFKKLIKDYKERDTEDIFCSDRENNLVKLYILMYILLPVEIRGDFLGFVKKNYYDLK<br>HVDFIDKRNNDNKDTFEHDLRLFEKNVKRLEVTSYSLSDGFLGKKSREKEGKELEKFIYKNVSIA<br>LPTNIDIKEENKSLVLPMMKNYQHFKLLNDIEISALFLIAKKEGNEGSITEKKVIDKVRKEDMNGN<br>INFSQVMKMALNEKVNCQIRNSIAHINMKQLYIEPLNIYINNNQNKKTISEQMEEIIDICITKGLTG<br>KELNKNIINDYYMKKEKLVFNLKLRKRNNLVSIDAQQKNMKEKSILNKYDLNYKDENLNIKEII<br>LKVNDLNNKQKLLKETTEGESNYKNALSKLDILLLNGIIRKNINFKIKEMILGIIQQNERYVNINIY<br>DKIRKEDHNIDLKINNKYIEISCYENKSNESTDERINFKIKYMDLKVKNELLVPSCYEDIYIKKKID<br>LEIRYIENCKVVYIDIYYKKYNINLEFDGKTLFVKFNKDVKKNNQKVNLESNYIQNIKFIVS |

Fusion Proteins

In some embodiments, the Cas protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR effector protein is part of a fusion protein comprising one or more heterologous protein domains (e.g. about or more than about 1, 2, 3, 4, 5, 6, 7, 8, 9, 10, or more domains in addition to the CRISPR enzyme). A CRISPR enzyme fusion protein may comprise any additional protein sequence, and optionally a linker sequence between any two domains. Examples of protein domains that may be fused to a CRISPR enzyme include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A CRISPR enzyme may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a CRISPR enzyme are described in US20110059502, incorporated herein by reference. In some embodiments, a tagged CRISPR enzyme is used to identify the location of a target sequence.

In some embodiments, a CRISPR effector protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome).In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety.

Recombination Templates

In some embodiments, a recombination template is also provided. The recombination template may be a component of a system herein. A recombination template may be a component of another vector as described herein, contained in a separate vector, or provided as a separate polynucleotide. In some embodiments, a recombination template is designed to serve as a template in homologous recombination, such as within or near a target sequence nicked or cleaved by a nucleic acid-targeting effector protein as a part of a nucleic acid-targeting complex.

In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include sequence that corresponds to a site on the target sequence that is cleaved by an Cas mediated cleavage event. In an embodiment, the template nucleic acid may include sequence that corresponds to both, a first site on the target sequence that is cleaved in a first Cas mediated event, and a second site on the target sequence that is cleaved in a second Cas mediated event.

In certain embodiments, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a target gene may be used to alter the structure of a target sequence. The template sequence may be used to alter an unwanted structure, e.g., an unwanted or mutant nucleotide. The template nucleic acid may include sequence which, when integrated, results in: decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

The template nucleic acid may include sequence which results in: a change in sequence of 1, 2, 3, 4, 5, 6, 7, 8, 9, 10, 11, 12 or more nucleotides of the target sequence.

A template polynucleotide may be of any suitable length, such as about or more than about 10, 15, 20, 25, 50, 75, 100, 150, 200, 500, 1000, or more nucleotides in length. In an embodiment, the template nucleic acid may be 20+/−10, 30+/−10, 40+/−10, 50+/−10, 60+/−10, 70+/−10, 80+/−10, 90+/−10, 100+/−10, 1 10+/−10, 120+/−10, 130+/−10, 140+/−10, 150+/−10, 160+/−10, 170+/−10, 1 80+/−10, 190+/−10, 200+/−10, 210+/−10, of 220+/−10 nucleotides in length. In an embodiment, the template nucleic acid may be 30+/−20, 40+/−20, 50+/−20, 60+/−20, 70+/−20, 80+/−20, 90+/−20, 100+/−20, 1 10+/−20, 120+/−20, 130+/−20, 140+/−20, 150+/−20, 160+/−20, 170+/−20, 180+/−20, 190+/−20, 200+/−20, 210+/−20, of 220+/−20 nucleotides in length. In an embodiment, the template nucleic acid is 10 to 1,000, 20 to 900, 30 to 800, 40 to 700, 50 to 600, 50 to 500, 50 to 400, 50 to300, 50 to 200, or 50 to 100 nucleotides in length.

In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 pb.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the invention can be constructed using recombinant techniques (see, for example, Sambrook et al., 2001 and Ausubel et al., 1996).

In certain embodiments, a template nucleic acids for correcting a mutation may designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

Suzuki et al. describe in vivo genome editing via CRISPR/Cas9 mediated homology-independent targeted integration (2016, Nature 540:144-149).

Systems

The invention also provides an engineered, non-naturally occurring Clustered Regularly Interspersed Short Palindromic Repeats (CRISPR)-CRISPR associated (Cas effector module) (CRISPR-Cas effector module) system. In some embodiments, the system may be a vector system comprising one or more vectors comprising: a) a first regulatory element operably linked to a nucleotide sequence encoding a non-naturally-occurring CRISPR enzyme of any one of the inventive constructs herein; and b) a second regulatory element operably linked to one or more nucleotide sequences encoding one or more of the guide RNAs, the guide RNA comprising a guide sequence, a direct repeat sequence, wherein: components (a) and (b) are located on same or different vectors, the CRISPR complex is formed; the guide RNA targets the target polynucleotide loci and the enzyme alters the polynucleotide loci, and the enzyme in the CRISPR complex has reduced capability of modifying one or more off-target loci as compared to an unmodified enzyme and/or whereby the enzyme in the CRISPR complex has increased capability of modifying the one or more target loci as compared to an unmodified enzyme.

As used herein, a CRISPR Cas effector module or CRISPR effector module includes, but is not limited to, Cas9, Cpf1, Cas12b, Cas12c, Cas13a, Cas13b, Cas13c, and Cas13d. In some embodiments, the CRISPR-Cas effector module may be engineered.

In such a system, component (II) may comprise a first regulatory element operably linked to a polynucleotide sequence which comprises the guide sequence, the direct repeat sequence, and wherein component (II) may comprise a second regulatory element operably linked to a polynucleotide sequence encoding the CRISPR enzyme. In such a system, where applicable the guide RNA may comprise a chimeric RNA.

In such a system, component (I) may comprise a first regulatory element operably linked to the guide sequence and the direct repeat sequence, and wherein component (II) may comprise a second regulatory element operably linked to a polynucleotide sequence encoding the CRISPR enzyme. Such a system may comprise more than one guide RNA, and each guide RNA has a different target whereby there is multiplexing. Components (a) and (b) may be on the same vector.

In any such systems comprising vectors, the one or more vectors may comprise one or more viral vectors, such as one or more retrovirus, lentivirus, adenovirus, adeno-associated virus or herpes simplex virus.

In any such systems comprising regulatory elements, at least one of said regulatory elements may comprise a tissue-specific promoter. The tissue-specific promoter may direct expression in a mammalian blood cell, in a mammalian liver cell or in a mammalian eye.

In any of the above-described compositions or systems the direct repeat sequence, may comprise one or more protein-interacting RNA aptamers. The one or more aptamers may be located in the tetraloop. The one or more aptamers may be capable of binding MS2 bacteriophage coat protein.

In any of the above-described compositions or systems the cell may be a eukaryotic cell or a prokaryotic cell; wherein the CRISPR complex is operable in the cell, and whereby the enzyme of the CRISPR complex has reduced capability of modifying one or more off-target loci of the cell as compared to an unmodified enzyme and/or whereby the enzyme in the CRISPR complex has increased capability of modifying the one or more target loci as compared to an unmodified enzyme.

The invention also provides a CRISPR complex of any of the above-described compositions or from any of the above-described systems.

The invention also provides a method of modifying a locus of interest in a cell comprising contacting the cell with any of the herein-described engineered CRISPR enzymes (e.g. engineered Cas effector module), compositions or any of the herein-described systems or vector systems, or wherein the cell comprises any of the herein-described CRISPR complexes present within the cell. In such methods the cell may be a prokaryotic or eukaryotic cell, preferably a eukaryotic cell. In such methods, an organism may comprise the cell. In such methods the organism may not be a human or other animal.

In certain embodiment, the invention also provides a non-naturally-occurring, engineered composition (e.g., engineered Cas9, Cpf1, Cas12b, Cas12c, Cas13a, Cas13b, Cas13c, and Casl3d, or any Cas protein which can fit into an AAV vector). Reference is made to FIGS. 19A, 19B, 19C, 19D, and 20A-F in U.S. Pat. No. 8,697,359 herein incorporated by reference to provide a list and guidance for other proteins which may also be used.

Any such method may be ex vivo or in vitro.

In certain embodiments, a nucleotide sequence encoding at least one of said guide RNA or Cas effector module is operably connected in the cell with a regulatory element comprising a promoter of a gene of interest, whereby expression of at least one CRISPR-Cas effector module system component is driven by the promoter of the gene of interest. "Operably connected" is intended to mean that the nucleotide sequence encoding the guide RNA and/or the Cas effector module is linked to the regulatory element(s) in a manner that allows for expression of the nucleotide sequence, as also referred to herein elsewhere. The term "regulatory element" is also described herein elsewhere. According to the invention, the regulatory element comprises a promoter of a gene of interest, such as preferably a promoter of an endogenous gene of interest. In certain embodiments, the promoter is at its endogenous genomic location. In such embodiments, the nucleic acid encoding the CRISPR and/or Cas effector module is under transcriptional control of the promoter of the gene of interest at its native genomic location. In certain other embodiments, the promoter is provided on a (separate) nucleic acid molecule, such as a vector or plasmid, or other extrachromosomal nucleic acid, i.e. the promoter is not provided at its native genomic location. In certain embodiments, the promoter is genomically integrated at a non-native genomic location.

The invention also provides a method of altering the expression of a genomic locus of interest in a mammalian cell comprising contacting the cell with the engineered CRISPR enzymes (e.g. engineered Cas effector module), compositions, systems or CRISPR complexes described herein and thereby delivering the CRISPR-Cas effector module (vector) and allowing the CRISPR-Cas effector module complex to form and bind to target, and determining if the expression of the genomic locus has been altered, such as increased or decreased expression, or modification of a gene product.

The invention further provides for a method of making mutations to a Cas effector module or a mutated or modified Cas effector module that is an ortholog of the CRISPR enzymes according to the invention as described herein, comprising ascertaining amino acid(s) in that ortholog may be in close proximity or may touch a nucleic acid molecule, e.g., DNA, RNA, gRNA, etc., and/or amino acid(s) analogous or corresponding to herein-identified amino acid(s) in CRISPR enzymes according to the invention as described herein for modification and/or mutation, and synthesizing or preparing or expressing the orthologue comprising, consisting of or consisting essentially of modification(s) and/or mutation(s) or mutating as herein-discussed, e.g., modifying, e.g., changing or mutating, a neutral amino acid to a charged, e.g., positively charged, amino acid, e.g., Alanine. The so modified ortholog can be used in CRISPR-Cas effector module systems; and nucleic acid molecule(s) expressing it may be used in vector systems that deliver molecules or encoding CRISPR-Cas effector module system components as herein-discussed.

In one aspect, the invention provides a kit comprising one or more of the components described herein. In some embodiments, the kit comprises a vector system and instructions for using the kit. In some embodiments, the vector system comprises (a) a first regulatory element operably linked to a direct repeat sequence and one or more insertion sites for inserting one or more guide sequences downstream of the DR sequence, wherein when expressed, the guide sequence directs sequence-specific binding of a CRISPR-Cas effector module complex to a target sequence in a eukaryotic cell, wherein the CRISPR-Cas effector module complex comprises a Cas effector module complexed with (1) the guide sequence that is hybridized to the target sequence, and (2) the DR sequence; and/or (b) a second regulatory element operably linked to an enzyme-coding sequence encoding said Cas effector module comprising a nuclear localization sequence and advantageously this includes a split Cas effector module. In some embodiments, the kit comprises components (a) and (b) located on the same or different vectors of the system. In some embodiments, component (a) further comprises two or more guide sequences operably linked to the first regulatory element, wherein when expressed, each of the two or more guide sequences direct sequence specific binding of a CRISPR-Cas effector module complex to a different target sequence in a eukaryotic cell.

In one aspect, the invention provides a method of modifying a target polynucleotide in a eukaryotic cell. In some embodiments, the method comprises allowing a CRISPR-Cas effector module complex to bind to the target polynucleotide to effect cleavage of said target polynucleotide thereby modifying the target polynucleotide, wherein the CRISPR-Cas effector module complex comprises a Cas effector module complexed with a guide sequence hybridized to a target sequence within said target polynucleotide, wherein said guide sequence is linked to a direct repeat sequence. In some embodiments, said cleavage comprises cleaving one or two strands at the location of the target sequence by said Cas effector module; this includes a split Cas effector module. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein the one or more vectors drive expression of one or more of: the Cas effector module, and the guide sequence linked to the DR sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

In one aspect, the invention provides a method of modifying expression of a polynucleotide in a eukaryotic cell. In some embodiments, the method comprises allowing a CRISPR-Cas effector module complex to bind to the polynucleotide such that said binding results in increased or decreased expression of said polynucleotide; wherein the CRISPR-Cas effector module complex comprises a Cas effector module complexed with a guide sequence hybridized to a target sequence within said polynucleotide, wherein said guide sequence is linked to a direct repeat sequence; which may include a split Cas effector module. In some embodiments, the method further comprises delivering one or more vectors to said eukaryotic cells, wherein the one or more vectors drive expression of one or more of: the Cas effector module, and the guide sequence linked to the DR sequence.

In one aspect, the invention provides a method of generating a model eukaryotic cell comprising a mutated disease gene. In some embodiments, a disease gene is any gene associated an increase in the risk of having or developing a disease. In some embodiments, the method comprises (a) introducing one or more vectors into a eukaryotic cell, wherein the one or more vectors drive expression of one or more of: Cas effector module, and a guide sequence linked to a direct repeat sequence; and (b) allowing a CRISPR-Cas effector module complex to bind to a target polynucleotide to effect cleavage of the target polynucleotide within said disease gene, wherein the CRISPR-Cas effector module complex comprises a Cas effector module complexed with (1) the guide sequence that is hybridized to the target sequence within the target polynucleotide, and (2) the DR sequence, thereby generating a model eukaryotic cell comprising a mutated disease gene; this includes a split Cas effector module. In some embodiments, said cleavage comprises cleaving one or two strands at the location of the target sequence by said Cas effector module. In a preferred embodiment, the strand break is a staggered cut with a 5' overhang. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence.

In one aspect the invention provides for a method of selecting one or more cell(s) by introducing one or more mutations in a gene in the one or more cell (s), the method comprising: introducing one or more vectors into the cell (s), wherein the one or more vectors drive expression of one or more of: a Cas effector module, a guide sequence linked to a direct repeat sequence, and an editing template; wherein the editing template comprises the one or more mutations that abolish Cas effector module cleavage; allowing homologous recombination of the editing template with the target polynucleotide in the cell(s) to be selected; allowing a CRISPR-Cas effector module complex to bind to a target polynucleotide to effect cleavage of the target polynucleotide within said gene, wherein the CRISPR-Cas effector module complex comprises the Cas effector module complexed with (1) the guide sequence that is hybridized to the target sequence within the target polynucleotide, and (2) the direct repeat sequence, wherein binding of the Cas effector module CRISPR-Cas effector module complex to the target polynucleotide induces cell death, thereby allowing one or more cell(s) in which one or more mutations have been introduced to be selected; this includes a split Cas effector module. In another preferred embodiment of the invention the cell to be selected may be a eukaryotic cell. Aspects of the invention allow for selection of specific cells without requiring a selection marker or a two-step process that may include a counter-selection system.

Compositions comprising a Cas effector module, complex or system comprising multiple guide RNAs, preferably tandemly arranged, or the polynucleotide or vector encoding or comprising said Cas effector module, complex or system comprising multiple guide RNAs, preferably tandemly arranged, for use in the methods of treatment as defined herein elsewhere are also provided. A kit of parts may be provided including such compositions. Use of said composition in the manufacture of a medicament for such methods of treatment are also provided. Use of a Cas effector module CRISPR system in screening is also provided by the present invention, e.g., gain of function screens. Cells which are artificially forced to overexpress a gene are able to down regulate the gene over time (re-establishing equilibrium) e.g. by negative feedback loops. By the time the screen starts the unregulated gene might be reduced again. Using an inducible Cas effector module activator allows one to induce transcription right before the screen and therefore minimizes the chance of false negative hits. Accordingly, by use of the instant invention in screening, e.g., gain of function screens, the chance of false negative results may be minimized.

In another aspect, the invention provides an engineered, non-naturally occurring vector system comprising one or more vectors comprising a first regulatory element operably linked to the multiple Cas effector module CRISPR system guide RNAs that each specifically target a DNA molecule encoding a gene product and a second regulatory element operably linked coding for a CRISPR protein. Both regulatory elements may be located on the same vector or on different vectors of the system. The multiple guide RNAs target the multiple DNA molecules encoding the multiple gene products in a cell and the CRISPR protein may cleave the multiple DNA molecules encoding the gene products (it may cleave one or both strands or have substantially no nuclease activity), whereby expression of the multiple gene products is altered; and, wherein the CRISPR protein and the multiple guide RNAs do not naturally occur together. In a preferred embodiment the CRISPR protein is a Cas effector module, optionally codon optimized for expression in a eukaryotic cell. In a preferred embodiment the eukaryotic cell is a mammalian cell, a plant cell or a yeast cell and in a more preferred embodiment the mammalian cell is a human cell. In a further embodiment of the invention, the expression of each of the multiple gene products is altered, preferably decreased.

In one aspect, the invention provides a vector system comprising one or more vectors. In some embodiments, the system comprises: (a) a first regulatory element operably linked to a direct repeat sequence and one or more insertion sites for inserting one or more guide sequences up- or downstream (whichever applicable) of the direct repeat sequence, wherein when expressed, the one or more guide sequence(s) direct(s) sequence-specific binding of the CRISPR complex to the one or more target sequence(s) in a eukaryotic cell, wherein the CRISPR complex comprises a Cas effector module complexed with the one or more guide sequence(s) that is hybridized to the one or more target sequence(s); and (b) a second regulatory element operably linked to an enzyme-coding sequence encoding said Cas effector module, preferably comprising at least one nuclear localization sequence and/or at least one NES; wherein components (a) and (b) are located on the same or different vectors of the system. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the CRISPR complex comprises one or more nuclear localization sequences and/or one or more NES of sufficient strength to drive accumulation of said CRISPR complex in a detectable amount in or out of the nucleus of a eukaryotic cell. In some embodiments, the first regulatory element is a polymerase III promoter. In some embodiments, the second regulatory element is a polymerase II promoter. In some embodiments, each of the guide sequences is at least 16, 17, 18, 19, 20, 25 nucleotides, or between 16-30, or between 16-25, or between 16-20 nucleotides in length.

Recombinant expression vectors can comprise the polynucleotides encoding the Cas effector module, system or complex for use in multiple targeting as defined herein in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

In some embodiments, a host cell is transiently or non-transiently transfected with one or more vectors comprising the polynucleotides encoding the Cas effector module, system or complex for use in multiple targeting as defined herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art and exemplified herein elsewhere. Cell lines are available from a variety of sources known to those with skill in the art (see, e.g., the American Type Culture Collection (ATCC) (Manassas, Va.)). In some embodiments, a cell transfected with one or more vectors comprising the polynucleotides encoding the Cas effector module, system or complex for use in multiple targeting as defined herein is used to establish a new cell line comprising one or more vector-derived sequences. In some embodiments, a cell transiently transfected with the components of a Cas effector module. system or complex for use in multiple targeting as described herein (such as by transient transfection of one or more vectors, or transfection with RNA), and modified through the activity of a Cas effector module, system or complex, is used to establish a new cell line comprising cells containing the modification but lacking any other exogenous sequence. In some embodiments, cells transiently or non-transiently transfected with one or more vectors comprising the polynucleotides encoding Cas effector module, system or complex for use in multiple targeting as defined herein, or cell lines derived from such cells are used in assessing one or more test compounds.

Advantageous vectors include lentiviruses and adeno-associated viruses, and types of such vectors can also be selected for targeting particular types of cells.

In one aspect, the invention provides a eukaryotic host cell comprising (a) a first regulatory element operably linked to a direct repeat sequence and one or more insertion sites for inserting one or more guide RNA sequences up- or downstream (whichever applicable) of the direct repeat sequence, wherein when expressed, the guide sequence(s) direct(s) sequence-specific binding of the CRISPR complex to the respective target sequence(s) in a eukaryotic cell, wherein the CRISPR complex comprises a Cas effector module complexed with the one or more guide sequence(s) that is hybridized to the respective target sequence(s); and/or (b) a second regulatory element operably linked to an enzyme-coding sequence encoding said Cas effector module comprising preferably at least one nuclear localization sequence and/or NES. In some embodiments, the host cell comprises components (a) and (b). In some embodiments, component (a), component (b), or components (a) and (b) are stably integrated into a genome of the host eukaryotic cell. In some embodiments, component (a) further comprises two or more guide sequences operably linked to the first regulatory element, and optionally separated by a direct repeat, wherein when expressed, each of the two or more guide sequences direct sequence specific binding of a CRISPR complex to a different target sequence in a eukaryotic cell. In some embodiments, the Cas effector module comprises one or more nuclear localization sequences and/or nuclear export sequences or NES of sufficient strength to drive accumulation of said CRISPR enzyme in a detectable amount in and/or out of the nucleus of a eukaryotic cell.

In certain aspects the invention involves vectors. Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s) (e.g., sgRNAs); and, when a single vector provides for more than 16 RNA(s) (e.g., sgRNAs), one or more promoter(s) can drive expression of more than one of the RNA(s) (e.g., sgRNAs), e.g., when there are 32 RNA(s) (e.g., sgRNAs), each promoter can drive expression of two RNA(s) (e.g., sgRNAs), and when there are 48 RNA(s) (e.g., sgRNAs), each promoter can drive expression of three RNA(s) (e.g., sgRNAs). By simple arithmetic and well established cloning protocols and the teachings in this disclosure one skilled in the art can readily practice the invention as to the RNA(s) (e.g., sgRNA(s) for a suitable exemplary vector such as AAV, and a suitable promoter such as the U6 promoter, e.g., U6-sgRNAs. For example, the packaging limit of AAV is ~4.7 kb. The length of a single U6-sgRNA (plus restriction sites for cloning) is 361 bp. Therefore, the skilled person can readily fit about 12-16, e.g., 13 U6-sgRNA cassettes in a single vector. This can be assembled by any suitable means, such as a golden gate strategy used for TALE assembly (www.genome-engineering.org/taleffectors/). The skilled person can also use a tandem guide strategy to increase the number of U6-sgRNAs by approximately 1.5 times, e.g., to increase from 12-16, e.g., 13 to approximately 18-24, e.g., about 19 U6-sgRNAs. Therefore, one skilled in the art can readily reach approximately 18-24, e.g., about 19 promoter-RNAs, e.g., U6-sgRNAs in a single vector, e.g., an AAV vector. A further means for increasing the number of promoters and RNAs, e.g., sgRNA(s) in a vector is to use a single promoter (e.g., U6) to express an array of RNAs, e.g., sgRNAs separated by cleavable sequences. And an even further means for increasing the number of promoter-RNAs, e.g., sgRNAs in a vector, is to express an array of promoter-RNAs, e.g., sgRNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjournals.org/content/34/7/e53.short, www.nature.com/mt/journal/v16/n9/abs/mt2008144a.html). In an advantageous embodiment, AAV may package U6 tandem sgRNA targeting up to about 50 genes. Accordingly, from the knowledge in the art and the teachings in this disclosure the skilled person can readily make and use vector(s), e.g., a single vector, expressing multiple RNAs or guides or sgRNAs under the control or operatively or functionally linked to one or more promoters-especially as to the numbers of RNAs or guides or sgRNAs discussed herein, without any undue experimentation.

In some embodiments, a loop in the guide RNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In certain embodiments, a nucleotide sequence encoding at least one of said guide RNA or Cas effector module is operably connected in the cell with a regulatory element comprising a promoter of a gene of interest, whereby expression of at least one CRISPR-Cas effector module system component is driven by the promoter of the gene of interest. "Operably connected" is intended to mean that the nucleotide sequence encoding the guide RNA and/or the Cas effector module is linked to the regulatory element(s) in a manner that allows for expression of the nucleotide sequence, as also referred to herein elsewhere. The term "regulatory element" is also described herein elsewhere. According to the invention, the regulatory element comprises a promoter of a gene of interest, such as preferably a promoter of an endogenous gene of interest. In certain embodiments, the promoter is at its endogenous genomic location. In such embodiments, the nucleic acid encoding the CRISPR and/or Cas effector module is under transcriptional control of the promoter of the gene of interest at its native genomic location. In certain other embodiments, the promoter is provided on a (separate) nucleic acid molecule, such as a vector or plasmid, or other extrachromosomal nucleic acid, i.e. the promoter is not provided at its native genomic location. In certain embodiments, the promoter is genomically integrated at a non-native genomic location.

The invention also provides a method of altering the expression of a genomic locus of interest in a mammalian cell comprising contacting the cell with the engineered CRISPR enzymes (e.g. engineered Cas effector module), compositions, systems or CRISPR complexes described herein and thereby delivering the CRISPR-Cas effector module (vector) and allowing the CRISPR-Cas effector module complex to form and bind to target, and determining if the expression of the genomic locus has been altered, such as increased or decreased expression, or modification of a gene product.

The invention further provides for a method of making mutations to a Cas effector module or a mutated or modified Cas effector module that is an ortholog of the CRISPR enzymes according to the invention as described herein, comprising ascertaining amino acid(s) in that ortholog may be in close proximity or may touch a nucleic acid molecule, e.g., DNA, RNA, gRNA, etc., and/or amino acid(s) analogous or corresponding to herein-identified amino acid(s) in CRISPR enzymes according to the invention as described herein for modification and/or mutation, and synthesizing or preparing or expressing the orthologue comprising, consisting of or consisting essentially of modification(s) and/or mutation(s) or mutating as herein-discussed, e.g., modifying, e.g., changing or mutating, a neutral amino acid to a charged, e.g., positively charged, amino acid, e.g., Alanine. The so modified ortholog can be used in CRISPR-Cas effector module systems; and nucleic acid molecule(s) expressing it may be used in vector systems that deliver molecules or encoding CRISPR-Cas effector module system components as herein-discussed.

In one aspect, the invention provides a kit comprising one or more of the components described herein. In some embodiments, the kit comprises a vector system and instructions for using the kit. In some embodiments, the vector system comprises (a) a first regulatory element operably linked to a direct repeat sequence and one or more insertion sites for inserting one or more guide sequences downstream of the DR sequence, wherein when expressed, the guide sequence directs sequence-specific binding of a CRISPR-Cas effector module complex to a target sequence in a eukaryotic cell, wherein the CRISPR-Cas effector module complex comprises a Cas effector module complexed with (1) the guide sequence that is hybridized to the target sequence, and (2) the DR sequence; and/or (b) a second regulatory element operably linked to an enzyme-coding sequence encoding said Cas effector module comprising a nuclear localization sequence and advantageously this includes a split Cas effector module. In some embodiments, the kit comprises components (a) and (b) located on the same or different vectors of the system. In some embodiments, component (a) further comprises two or more guide sequences operably linked to the first regulatory element, wherein when expressed, each of the two or more guide sequences direct sequence specific binding of a CRISPR-Cas effector module complex to a different target sequence in a eukaryotic cell.

In one aspect, the invention provides a method of modifying a target polynucleotide in a eukaryotic cell. In some embodiments, the method comprises allowing a CRISPR-Cas effector module complex to bind to the target polynucleotide to effect cleavage of said target polynucleotide thereby modifying the target polynucleotide, wherein the CRISPR-Cas effector module complex comprises a Cas effector module complexed with a guide sequence hybridized to a target sequence within said target polynucleotide, wherein said guide sequence is linked to a direct repeat sequence. In some embodiments, said cleavage comprises cleaving one or two strands at the location of the target sequence by said Cas effector module; this includes a split Cas effector module. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein the one or more vectors drive expression of one or more of: the Cas effector module, and the guide sequence linked to the DR sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

In one aspect, the invention provides a method of modifying expression of a polynucleotide in a eukaryotic cell. In some embodiments, the method comprises allowing a CRISPR-Cas effector module complex to bind to the polynucleotide such that said binding results in increased or decreased expression of said polynucleotide; wherein the CRISPR-Cas effector module complex comprises a Cas effector module complexed with a guide sequence hybridized to a target sequence within said polynucleotide, wherein said guide sequence is linked to a direct repeat sequence; which may include a split Cas effector module. In some embodiments, the method further comprises delivering one or more vectors to said eukaryotic cells, wherein the one or more vectors drive expression of one or more of: the Cas effector module, and the guide sequence linked to the DR sequence.

In one aspect, the invention provides a method of generating a model eukaryotic cell comprising a mutated disease gene. In some embodiments, a disease gene is any gene associated an increase in the risk of having or developing a disease. In some embodiments, the method comprises (a) introducing one or more vectors into a eukaryotic cell, wherein the one or more vectors drive expression of one or more of: Cas effector module, and a guide sequence linked to a direct repeat sequence; and (b) allowing a CRISPR-Cas effector module complex to bind to a target polynucleotide to effect cleavage of the target polynucleotide within said disease gene, wherein the CRISPR-Cas effector module complex comprises a Cas effector module complexed with (1) the guide sequence that is hybridized to the target sequence within the target polynucleotide, and (2) the DR sequence, thereby generating a model eukaryotic cell comprising a mutated disease gene; this includes a split Cas effector module. In some embodiments, said cleavage comprises cleaving one or two strands at the location of the target sequence by said Cas effector module. In a preferred embodiment, the strand break is a staggered cut with a 5' overhang. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence.

In one aspect the invention provides for a method of selecting one or more cell(s) by introducing one or more mutations in a gene in the one or more cell (s), the method comprising: introducing one or more vectors into the cell (s), wherein the one or more vectors drive expression of one or more of: a Cas effector module, a guide sequence linked to a direct repeat sequence, and an editing template; wherein the editing template comprises the one or more mutations that abolish Cas effector module cleavage; allowing homologous recombination of the editing template with the target polynucleotide in the cell(s) to be selected; allowing a CRISPR-Cas effector module complex to bind to a target polynucleotide to effect cleavage of the target polynucleotide within said gene, wherein the CRISPR-Cas effector module complex comprises the Cas effector module complexed with (1) the guide sequence that is hybridized to the target sequence within the target polynucleotide, and (2) the direct repeat sequence, wherein binding of the Cas effector module CRISPR-Cas effector module complex to the target polynucleotide induces cell death, thereby allowing one or more cell(s) in which one or more mutations have been introduced to be selected; this includes a split Cas effector module. In another preferred embodiment of the invention the cell to be selected may be a eukaryotic cell. Aspects of the invention allow for selection of specific cells without requiring a selection marker or a two-step process that may include a counter-selection system.

Compositions comprising a Cas effector module, complex or system comprising multiple guide RNAs, preferably tandemly arranged, or the polynucleotide or vector encoding or comprising said Cas effector module, complex or system comprising multiple guide RNAs, preferably tandemly arranged, for use in the methods of treatment as defined herein elsewhere are also provided. A kit of parts may be provided including such compositions. Use of said composition in the manufacture of a medicament for such methods of treatment are also provided. Use of a Cas effector module CRISPR system in screening is also provided by the present invention, e.g., gain of function screens. Cells which are artificially forced to overexpress a gene are able to down regulate the gene over time (re-establishing equilibrium) e.g. by negative feedback loops. By the time the screen starts the unregulated gene might be reduced again. Using an inducible Cas effector module activator allows one to induce transcription right before the screen and therefore minimizes the chance of false negative hits. Accordingly, by use of the instant invention in screening, e.g., gain of function screens, the chance of false negative results may be minimized.

In another aspect, the invention provides an engineered, non-naturally occurring vector system comprising one or more vectors comprising a first regulatory element operably linked to the multiple Cas effector module CRISPR system guide RNAs that each specifically target a DNA molecule encoding a gene product and a second regulatory element operably linked coding for a CRISPR protein. Both regulatory elements may be located on the same vector or on different vectors of the system. The multiple guide RNAs target the multiple DNA molecules encoding the multiple gene products in a cell and the CRISPR protein may cleave the multiple DNA molecules encoding the gene products (it may cleave one or both strands or have substantially no nuclease activity), whereby expression of the multiple gene products is altered; and, wherein the CRISPR protein and the multiple guide RNAs do not naturally occur together. In a preferred embodiment the CRISPR protein is a Cas effector module, optionally codon optimized for expression in a eukaryotic cell. In a preferred embodiment the eukaryotic cell is a mammalian cell, a plant cell or a yeast cell and in a more preferred embodiment the mammalian cell is a human cell. In a further embodiment of the invention, the expression of each of the multiple gene products is altered, preferably decreased.

In one aspect, the invention provides a vector system comprising one or more vectors. In some embodiments, the system comprises: (a) a first regulatory element operably linked to a direct repeat sequence and one or more insertion sites for inserting one or more guide sequences up- or downstream (whichever applicable) of the direct repeat sequence, wherein when expressed, the one or more guide sequence(s) direct(s) sequence-specific binding of the CRISPR complex to the one or more target sequence(s) in a eukaryotic cell, wherein the CRISPR complex comprises a Cas effector module complexed with the one or more guide sequence(s) that is hybridized to the one or more target sequence(s); and (b) a second regulatory element operably linked to an enzyme-coding sequence encoding said Cas effector module, preferably comprising at least one nuclear localization sequence and/or at least one NES; wherein components (a) and (b) are located on the same or different vectors of the system. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the CRISPR complex comprises one or more nuclear localization sequences and/or one or more NES of sufficient strength to drive accumulation of said CRISPR complex in a detectable amount in or out of the nucleus of a eukaryotic cell. In some embodiments, the first regulatory element is a polymerase III promoter. In some embodiments, the second regulatory element is a polymerase II promoter. In some embodiments, each of the guide sequences is at least 16, 17, 18, 19, 20, 25 nucleotides, or between 16-30, or between 16-25, or between 16-20 nucleotides in length.

Recombinant expression vectors can comprise the polynucleotides encoding the Cas effector module, system or complex for use in multiple targeting as defined herein in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

In some embodiments, a host cell is transiently or non-transiently transfected with one or more vectors comprising the polynucleotides encoding the Cas effector module, system or complex for use in multiple targeting as defined herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art and exemplified herein elsewhere. Cell lines are available from a variety of sources known to those with skill in the art (see, e.g., the American Type Culture Collection (ATCC) (Manassas, Va.)). In some embodiments, a cell transfected with one or more vectors comprising the polynucleotides encoding the Cas effector module, system or complex for use in multiple targeting as defined herein is used to establish a new cell line comprising one or more vector-derived sequences. In some embodiments, a cell transiently transfected with the components of a Cas effector module. system or complex for use in multiple targeting as described herein (such as by transient transfection of one or more vectors, or transfection with RNA), and modified through the activity of a Cas effector module, system or complex, is used to establish a new cell line comprising cells containing the modification but lacking any other exogenous sequence. In some embodiments, cells transiently or non-transiently transfected with one or more vectors comprising the polynucleotides encoding Cas effector module, system or complex for use in multiple targeting as defined herein, or cell lines derived from such cells are used in assessing one or more test compounds.

Advantageous vectors include lentiviruses and adeno-associated viruses, and types of such vectors can also be selected for targeting particular types of cells.

In one aspect, the invention provides a eukaryotic host cell comprising (a) a first regulatory element operably linked to a direct repeat sequence and one or more insertion sites for inserting one or more guide RNA sequences up- or downstream (whichever applicable) of the direct repeat sequence, wherein when expressed, the guide sequence(s) direct(s) sequence-specific binding of the CRISPR complex to the respective target sequence(s) in a eukaryotic cell, wherein the CRISPR complex comprises a Cas effector module complexed with the one or more guide sequence(s) that is hybridized to the respective target sequence(s); and/or (b) a second regulatory element operably linked to an enzyme-coding sequence encoding said Cas effector module comprising preferably at least one nuclear localization sequence and/or NES. In some embodiments, the host cell comprises components (a) and (b). In some embodiments, component (a), component (b), or components (a) and (b) are stably integrated into a genome of the host eukaryotic cell. In some embodiments, component (a) further comprises two or more guide sequences operably linked to the first regulatory element, and optionally separated by a direct repeat, wherein when expressed, each of the two or more guide sequences direct sequence specific binding of a CRISPR complex to a different target sequence in a eukaryotic cell. In some embodiments, the Cas effector module comprises one or more nuclear localization sequences and/or nuclear export sequences or NES of sufficient strength to drive accumulation of said CRISPR enzyme in a detectable amount in and/or out of the nucleus of a eukaryotic cell.

In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s) (e.g., sgRNAs); and, when a single vector provides for more than 16 RNA(s) (e.g., sgRNAs), one or more promoter(s) can drive expression of more than one of the RNA(s) (e.g., sgRNAs), e.g., when there are 32 RNA(s) (e.g., sgRNAs), each promoter can drive expression of two RNA(s) (e.g., sgRNAs), and when there are 48 RNA(s) (e.g., sgRNAs), each promoter can drive expression of three RNA(s) (e.g., sgRNAs). By simple arithmetic and well established cloning protocols and the teachings in this disclosure one skilled in the art can readily practice the invention as to the RNA(s) (e.g., sgRNA(s) for a suitable exemplary vector such as AAV, and a suitable promoter such as the U6 promoter, e.g., U6-sgRNAs. For example, the packaging limit of AAV is ~4.7 kb. The length of a single U6-sgRNA (plus restriction sites for cloning) is 361 bp. Therefore, the skilled person can readily fit about 12-16, e.g., 13 U6-sgRNA cassettes in a single vector. This can be assembled by any suitable means, such as a golden gate strategy used for TALE assembly (www.genome-engineering.org/taleffectors/). The skilled person can also use a tandem guide strategy to increase the number of U6-sgRNAs by approximately 1.5 times, e.g., to increase from 12-16, e.g., 13 to approximately 18-24, e.g., about 19 U6-sgRNAs. Therefore, one skilled in the art can readily reach approximately 18-24, e.g., about 19 promoter-RNAs, e.g., U6-sgRNAs in a single vector, e.g., an AAV vector. A further means for increasing the number of promoters and RNAs, e.g., sgRNA(s) in a vector is to use a single promoter (e.g., U6) to express an array of RNAs, e.g., sgRNAs separated by cleavable sequences. And an even further means for increasing the number of promoter-RNAs, e.g., sgRNAs in a vector, is to express an array of promoter-RNAs, e.g., sgRNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjournals.org/content/34/7/e53.short, www.nature.com/mt/journal/v16/n9/abs/mt2008144a.html). In an advantageous embodiment, AAV may package U6 tandem sgRNA targeting up to about 50 genes. Accordingly, from the knowledge in the art and the teachings in this disclosure the skilled person can readily make and use vector(s), e.g., a single vector, expressing multiple RNAs or guides or sgRNAs under the control or operatively or functionally linked to one or more promoters-especially as to the numbers of RNAs or guides or sgRNAs discussed herein, without any undue experimentation.

The guide RNA(s), e.g., sgRNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter (s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the R-actin promoter, the phosphoglycerol kinase (PGK) promoter, and the EF1α promoter. An advantageous promoter is the promoter is U6.

Aspects of the invention relate to bicistronic vectors for guide RNA and (optionally modified or mutated) Cas effector modules. Bicistronic expression vectors for guide RNA and (optionally modified or mutated) CRISPR enzymes are preferred. In general and particularly in this embodiment (optionally modified or mutated) CRISPR enzymes are preferably driven by the CBh promoter. The RNA may preferably be driven by a Pol III promoter, such as a U6 promoter. The two can be combined.

The term "regulatory element" is intended to include promoters, enhancers, internal ribosomal entry sites (IRES), and other expression control elements (e.g. transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g. liver, pancreas), or particular cell types (e.g. lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g. 1, 2, 3, 4, 5, or more pol III promoters), one or more pol II promoters (e.g. 1, 2, 3, 4, 5, or more pol II promoters), one or more pol I promoters (e.g. 1, 2, 3, 4, 5, or more pol I promoters), or combinations thereof. Examples of pol III promoters include, but are not limited to, U6 and Hi promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the R-actin promoter, the phosphoglycerol kinase (PGK) promoter, and the EFla promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89). In some embodiments, a vector is a yeast expression vector. Examples of vectors for expression in yeast *Saccharomyces cerevisiae* include pYepSecl (Baldari, et al., 1987. EMBO J. 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif), and picZ (InVitrogen Corp, San Diego, Calif.). In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39).

In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element is operably linked to one or more elements of a CRISPR system so as to drive expression of the one or more elements of the CRISPR system.

Typically, in the context of an endogenous nucleic acid-targeting system, formation of a nucleic acid-targeting complex (comprising a guide RNA hybridized to a target sequence and complexed with one or more nucleic acid-targeting effector modules) results in cleavage of one or both RNA strands in or near (e.g. within 1, 2, 3, 4, 5, 6, 7, 8, 9, 10, 20, 50, or more base pairs from) the target sequence. In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector module and a guide RNA could each be operably linked to separate regulatory elements on separate vectors. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector module and a guide RNA embedded within one or more intron sequences (e.g. each in a different intron, two or more in at least one intron, or all in a single intron). In some embodiments, the nucleic acid-targeting effector module and guide RNA are operably linked to and expressed from the same promoter.

Features of Exemplary Cas Proteins

The CRISPR-Cas systems and Cas proteins may be engineered or modified according to their features, e.g., structural features of the Cas proteins.

SaCas9

Structural characteristics of SaCas9 include those described in Nishimasu et al., Crystal Structure of *Staphylococcus aureus* Cas9, Cell 162, 1113-1126, Aug. 27, 2015.

Overall structure: SaCas9 adopts a bilobed architecture consisting of a recognition (REC) lobe (residues 41-425) and a nuclease (NUC) lobe (residues 1-40 and 435-1053). The two lobes are connected by an arginine-rich bridge helix (residues 41-73) and a linker loop (residues 426-434). The NUC lobe consists of the RuvC (residues 1-40, 435-480 and 650-774), HNH (residues 520-628), evolutionary divergent wedge (WED) (residues 788-909), and PAM-interacting (PI) (residues 910-1053) domains (FIGS. 1C and 1D). The PI domain can be divided into a Topoisomerase-homology (TOPO) domain and a C-terminal domain. The RuvC domain consists of three separate motifs (RuvC—I-III) and interacts with the HNH and PI domains. The HNH domain is connected to RuvCII and RuvC-III by the L1 (residues 481-519) and L2 (residues 629-649) linker regions, respectively. The WED and RuvC domains are connected by a "phosphate lock" loop (residues 775-787).

Guide: Target recognition: The guide:target heteroduplex is accommodated in the central channel formed between the REC and NUC lobes. The sugar-phosphate backbone of the PAM-distal region of the sgRNA interacts with the REC lobe (Thr238, Tyr239, Lys256, Arg314, Asn394, and Gln414). In SpCas9 and SaCas9, the RNA-DNA base pairing in the 8 bp PAM-proximal "seed" region in the guide:target heteroduplex is critical for Cas9-catalyzed DNA cleavage. Consistent with this, the phosphate backbone of the sgRNA seed region (C13-C20) is extensively recognized by the bridge helix (Asn44, Arg48, Arg51, Arg55, Arg59, and Arg60) and the REC lobe (Arg116, Gly117, Arg165, Gly166, Asn169, and Arg209). In addition, the 2'—OH groups of C15, U16, U17, and G19 of the sgRNA interact with the REC lobe (Gly166, Arg208, Arg209, and Tyr211). In addition, the sugar-phosphate backbone of the target DNA strand interacts with the REC lobe (Tyr211, Trp229, Tyr230, Gly235, Arg245, Gly391, Thr392, and Asn419) and the RuvC domain (Leu446, Tyr651 and Arg654). The C-terminal region of the REC lobe interacts with the PAM distal region of the heteroduplex, whereas the N-terminal region of the REC lobe interacts with the repeat:anti-repeat duplex and the PAM-proximal region of the heteroduplex.

sgRNA scaffold recognition: The repeat:anti-repeat duplex is recognized by theRECandWED domains, primarily through interactions between the protein and the sugar-phosphate backbone. Consistent with data showing that the distorted repeat:anti-repeat duplex is critical for Cas9-catalyzed DNA cleavage, the internal loop is recognized by the WED domain. The 2'—OH of C30 hydrogen bonds with Tyr868, and the backbone phosphate groups of U31, C45, and U46 interact with Lys870, Arg792, and Lys881, respectively.

Stem loop 1 is recognized by the bridge helix and the REC lobe. The phosphate backbone of stem loop 1 interacts with the bridge helix (Arg47, Arg54, Arg55, Arg58, and Arg59) and the REC lobe (Arg209, Gly216, and Ser219). The 2'-OH of A63 hydrogen bonds with His62. The flipped-out U64 is recognized by Arg209 and Glu213 via stacking and hydrogen-bonding interactions, respectively. A55 is extensively recognized by the phosphate lock loop. The N6, N7, and 2'-OH of A55 hydrogen bond with Asn780/Arg781, Leu783, and Lys906, respectively. Lys57 interacts with the backbone phosphate group between C54 and A55, and the side chain of Leu783 forms hydrophobic contacts with the nucleobases of A55 and A56. The phosphate backbone of the linker region electrostatically interacts with the RuvC domain (Arg452, Lys459, and Arg774) and the phosphate lock loop (Arg781), and the nucleobase of G70 stacks with the side chain of Arg47 on the bridge helix.

PAM recognition: Consistent with the observed requirement for the 3rd G in the 5'-NNGRRT-3' PAM, the O6 and N7 of dG3* form bidentate hydrogen bonds with the side chain of Arg1015, which is anchored via salt bridges with Glu993 in both complexes. In the 5'-TTGAAT-3' PAM complex, the N7 atoms of dA4* and dA5* form direct and water-mediated hydrogen bonds with Asn985 and Asn985/Asn986/Arg991, respectively. In addition, the N6 of dA5* forms a water-mediated hydrogen bond with Asn985. Similarly, in the 5'-TTGGGT-3' PAM complex, the N7 atoms of dG4* and dG5* form direct and water-mediated hydrogen bonds with Asn985 and Asn985/Asn986/Arg991, respectively. The O6 of dG5* forms a water-mediated hydrogen bond with Asn985. These structural features explain the ability of SaCas9 to recognize the purine nucleotides at positions 4 and 5 in the 5'-NNGRRT-3' PAM. The O4 of dT6* hydrogen bonds with Arg991, explaining the preference of SaCas9 for the 6th T in the 5'-NNGRRT-3' PAM. Single alanine mutations of these PAM-interacting residues reduced the cleavage activity in vivo, and double mutations abolished the activity (FIG. 5C), confirming the importance of Asn985, Asn986, Arg991, Glu993, and Arg1015 for PAM recognition. In addition, the phosphate backbone of the PAM duplex is recognized from the minor groove side by the WED domain (Tyr789, Tyr882, Lys886, Ans888, Ala889, and Leu909).

Target DNA unwinding: In SaCas9, the +1 phosphate between dA(_1) and dG1, in the target DNA strand, hydrogen bonds with the main-chain amide groups of Asp786 and Thr787 and the side chain of Thr787 in the phosphate lock loop. These interactions result in the rotation of the +1 phosphate, thereby facilitating base-pairing between dG1 in the target DNA strand and C20 in the sgRNA. The SaCas9 T787A mutant showed reduced DNA cleavage activity, confirming the functional significance of Thr787 in the phosphate lock loop.

RuvC domain: The RuvC domain of SaCas9 has an RNase H fold and cleaves the non-target DNA strand through a two-metal ion mechanism. Asp10, Glu477, His701, and Asp704 have been shown to be important for catalysis; the D10A, E477A, H701A, and D704A mutants of SaCas9 exhibited almost no DNA cleavage activity.

HNH domain: The HNH domain of SaCas9 has a bba-metal fold and cleaves the target DNA strand through a one-metal ion mechanism. Asp556, His557, and Asn580 have been shown to be important for catalysis; the H557A and N580A mutants of SaCas9 almost completely lacked DNA cleavage activity.

SpCas9

Structural characteristics of SpCas9 include those described in Nishimasu et al., Crystal Structure of Cas9 in Complex with Guide RNA and Target DNA, Cell 156, 935-949, Feb. 27, 2014.

Overall structure: SpCas9 comprises two lobes: a recognition (REC) lobe and a nuclease (NUC) lobe. The REC lobe can be divided into three regions, a long α helix referred to as the bridge helix (residues 60-93), the REC1 (residues 94-179 and 308-713) domain, and the REC2 (residues 180-307) domain. The NUC lobe consists of the RuvC (residues 1-59, 718-769, and 909-1098), HNH (residues 775-908), and PAM-interacting (PI) (residues 1099-1368) domains. The negatively charged sgRNA:target DNA heteroduplex is accommodated in a positively charged groove at the interface between the REC and NUC lobes. In the NUC lobe, the RuvC domain is assembled from the three split RuvC motifs (RuvC I-III) and interfaces with the PI domain to form a positively charged surface that interacts with the 30 tail of the sgRNA. The HNH domain lies between the RuvC II-III motifs and forms only a few contacts with the rest of the protein.

REC lobe: The REC lobe includes the REC1 and REC2 domains. The REC2 domain does not contact the bound guide:target heteroduplex, indicating that truncation of REC lobe may be tolerated by SpCas9. Further, SpCas9 mutant lacking the REC2 domain (D175-307) retained ~50% of the wild-type Cas9 activity, indicating that the REC2 domain is not critical for DNA cleavage. In striking contrast, the deletion of either the repeat-interacting region (D97-150) or the anti-repeat-interacting region (D312-409) of the REC1 domain abolished the DNA cleavage activity, indicating that the recognition of the repeat:anti-repeat duplex by the REC1 domain is critical for the Cas9 function.

PAM-Interacting domain: The NUC lobe contains the PAM-interacting (PI) domain that is positioned to recognize the PAM sequence on the noncomplementary DNA strand. The PI domain of SpCas9 is required for the recognition of 5'-NGG-3' PAM, and deletion of the PI domain (A1099-1368) abolished the cleavage activity, indicating that the PI domain is critical for SpCas9 function and a major determinant for the PAM specificity.

RuvC domain: The RuvC nucleases of SpCas9 have an RNase H fold and four catalytic residues, Asp10 (Ala), Glu762, His983, and Asp986, that are critical for the two-metal cleavage of the noncomplementary strand of the target DNA. In addition to the conserved RNase H fold, the Cas9 RuvC domain has other structural elements involved in interactions with the guide:target heteroduplex (an end-capping loop between α42 and α43) and the PI domain/stem loop 3 (β hairpin formed by β3 and β4).

HNH domain: SpCas9 HNH nucleases have three catalytic residues, Asp839, His840, and Asn863 and cleave the complementary strand of the target DNA through a single-metal mechanism.

sgRNA:DNA recognition: The sgRNA guide region is primarily recognized by the REC lobe. The backbone phosphate groups of the guide region (nucleotides 2, 4-6, and 13-20) interact with the REC1 domain (Arg165, Gly166, Arg403, Asn407, Lys510, Tyr515, and Arg661) and the bridge helix (Arg63, Arg66, Arg70, Arg71, Arg74, and Arg78) (FIG. 6A). The 20-hydroxyl groups of G1, C15, U16, and G19 hydrogen bond with Val1009, Tyr450, Arg447/Ile448, and Thr404, respectively.

A mutational analysis demonstrated that the R66A, R70A, and R74A mutations on the bridge helix markedly reduced the DNA cleavage activities, highlighting the functional significance of the recognition of the sgRNA "seed" region by the bridge helix. Although Arg78 and Arg165 also interact with the "seed" region, the R78A and R165A mutants showed only moderately decreased activities. These results are consistent with the fact that Arg66, Arg70, and Arg74 form multiple salt bridges with the sgRNA backbone, whereas Arg78 and Arg165 form a single salt bridge with the sgRNA backbone. Moreover, the alanine mutations of the repeat:anti-repeat duplex-interacting residues (Arg75 and Lys163) and the stemloop-1-interacting residue (Arg69) resulted in decreased DNA cleavage activity, confirming the functional importance of the recognition of the repeat:anti-repeat duplex and stem loop 1 by Cas9.

RNA-guidedDNA targeting: SpCas9 recognizes the guide:target heteroduplex in a sequence-independent manner. The backbone phosphate groups of the target DNA (nucleotides 1', 9'-11', 13', and 20') interact with the REC1 (Asn497, Trp659, Arg661, and Gln695), RuvC (Gln926), and PI (Glu1108) domains. The C2' atoms of the target DNA (nucleotides 5', 7', 8', 11', 19', and 20') form van der Waals interactions with the REC1 domain (Leu169, Tyr450, Met495, Met694, and His698) and the RuvC domain (Ala728). The terminal base pair of the guide:target heteroduplex (G1:C20') is recognized by the RuvC domain via end-capping interactions; the sgRNA G1 and target DNA C20' nucleobases interact with the Tyr1013 and Val1015 side chains, respectively, whereas the 20-hydroxyl and phosphate groups of sgRNA G1 interact with Val1009 and Gln926, respectively.

Repeat:Anti-Repeat duplex recognition: The nucleobases of U23/A49 and A42/G43 hydrogen bond with the side chain of Arg1122 and the main-chain carbonyl group of Phe351, respectively. The nucleobase of the flipped U44 is sandwiched between Tyr325 and His328, with its N3 atom hydrogen bonded with Tyr325, whereas the nucleobase of the unpaired G43 stacks with Tyr359 and hydrogen bonds with Asp364.

The nucleobases of G21 and U50 in the G21:U50 wobble pair stack with the terminal C20:G10 pair in the guide:target heteroduplex and Tyr72 on the bridge helix, respectively, with the U50 04 atom hydrogen bonded with Arg75. Notably, A51 adopts the syn conformation and is oriented in the direction opposite to U50. The nucleobase of A51 is sandwiched between Phe1105 and U63, with its N1, N6, and N7 atoms hydrogen bonded with G62, Gly1103, and Phe1105, respectively.

Stem-loop recognition: Stem loop 1 is primarily recognized by the REC lobe, together with the PI domain. The backbone phosphate groups of stem loop 1 (nucleotides 52, 53, and 59-61) interact with the REC1 domain (Leu455, Ser460, Arg467, Thr472, and Ile473), the PI domain (Lys1123 and Lys1124), and the bridge helix (Arg70 and Arg74), with the 20-hydroxyl group of G58 hydrogen bonded with Leu455. A52 interacts with Phe1105 through a face-to-edge p-p stacking interaction, and the flipped U59 nucleobase hydrogen bonds with Asn77.

The single-stranded linker and stem loops 2 and 3 are primarily recognized by the NUC lobe. The backbone phosphate groups of the linker (nucleotides 63-65 and 67) interact with the RuvC domain (Glu57, Lys742, and Lys1097), the PI domain (Thr1102), and the bridge helix (Arg69), with the 20-hydroxyl groups of U64 and A65 hydrogen bonded with Glu57 and His721, respectively. The C67 nucleobase forms two hydrogen bonds with Val1100.

Stem loop 2 is recognized by Cas9 via the interactions between the NUC lobe and the non-Watson-Crick A68:G81 pair, which is formed by direct (between the A68 N6 and G81 06 atoms) and water-mediated (between the A68 N1 and G81 N1 atoms) hydrogen-bonding interactions (FIG. 6I). The A68 and G81 nucleobases contact Ser1351 and Tyr1356, respectively, whereas the A68:G81 pair interacts with Thr1358 via a watermediated hydrogen bond. The 20-hydroxyl group of A68 hydrogen bonds with His1349, whereas the G81 nucleobase hydrogen bonds with Lys33.

Stem loop 3 interacts with the NUC lobe more extensively, as compared to stem loop 2. The backbone phosphate group of G92 interacts with the RuvC domain (Arg40 and Lys44), whereas the G89 and U90 nucleobases hydrogen bond with Gln1272 and Glu1225/Ala1227, respectively. The A88 and C91 nucleobases are recognized by Asn46 via multiple hydrogen-bonding interactions.

Cpf1

The present invention encompasses the use of a Cpf1 effector protein, derived from a Cpf1 locus denoted as subtype V-A. Herein such effector proteins are also referred to as "Cpf1p", e.g., a Cpf1 protein (and such effector protein or Cpf1 protein or protein derived from a Cpf1 locus is also called "CRISPR enzyme"). Presently, the subtype V-A loci encompasses cas1, cas2, a distinct gene denoted cpf1 and a CRISPR array. Cpf1 (CRISPR-associated protein Cpf1, subtype PREFRAN) is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in all Cas9 proteins, and the RuvC-like domain is contiguous in the Cpf1 sequence, in contrast to Cas9 where it contains long inserts including the HNH domain. Accordingly, in particular embodiments, the CRISPR-Cas enzyme comprises only a RuvC-like nuclease domain.

FnCpf1

Structural characteristics of FnCpf1 include those described in (Swarts et al., Structural Basis for Guide RNA Processing and Seed-Dependent DNA Targeting by CRISPR-Cas12a, Molecular Cell 66, 221-233, Apr. 20, 2017.

Overall structure: FnCpf1 adopts a bilobed architecture with the two lobes connected by the wedge (WED) domain. The N-terminal REC lobe consists of two a-helical domains (REC1 and REC2) that have been shown to coordinate the crRNA-target DNA heteroduplex. The C-terminal NUC lobe consists of the C-terminal RuvC and Nuc domains involved in target cleavage, the arginine-rich bridge helix (BH), and the PAM-interacting (PI) domain. The repeat-derived segment of the crRNA forms a pseudoknot stabilized by intramolecular base-pairing and hydrogen-bonding interactions. The pseudoknot is coordinated by residues from the WED, RuvC, and REC2 domains, as well as by two hydrated magnesium cations. Notably, nucleotides 1-5 of the crRNA are ordered in the central cavity of FnCas12a and adopt an A-form-like helical conformation. Conformational ordering of the seed sequence is facilitated by multiple interactions between the ribose and phosphate moieties of the crRNA backbone and FnCas12a residues in the WED and REC1 domains. These include residues Thr16, Lys595, His804, and His881 from the WED domain and residues Tyr47, Lys51, Phe182, and Arg186 from the REC1 domain. The structure of the FnCas12a-crRNA complex further reveals that the bases of the seed sequence are solvent exposed and poised for hybridization with target DNA.

Pre-crRNA processing: Essential restudies for crRNA processing include His843, Lys852, and Lys869. Structural observations are consistent with an acid-base catalytic mechanism in which Lys869 acts as the general base catalyst to deprotonate the attacking 2'-hydroxyl group of U(−19), while His843 acts as a general acid to protonate the 5'-oxygen leaving group of A(−18). In turn, the side chain of Lys852 is involved in charge stabilization of the transition state. Collectively, these interactions facilitate the intramolecular attack of the 20-hydroxyl group of U(−19) on the scissile phosphate and promote the formation of the 2',3'-cyclic phosphate product.

R-loop formation: The crRNA-target DNA strand heteroduplex is enclosed in the central cavity formed by the REC and NUC lobes and interacts extensively with the REC1 and REC2 domains. The PAM-containing DNA duplex comprises target strand nucleotides dT0-dT8 and non-target strand nucleotides dA(8)*-dA0* and is contacted by the PI, WED, and REC1 domains. The 5'-TTN-3' PAM is recognized in FnCas12a by a mechanism combining the shape-specific recognition of a narrowed minor groove, with base-specific recognition of the PAM bases by two invariant residues, Lys671 and Lys613. Directly downstream of the PAM, the duplex of the target DNA is disrupted by the side chain of residue Lys667, which is inserted between the DNA strands and forms a cation-7c stacking interaction with the dA0-dT0* base pair. The phosphate group linking target strand residues dT(−1) and dT0 is coordinated by hydrogen-bonding interactions with the side chain of Lys823 and the backbone amide of Gly826. Target strand residue dT(−1) bends away from residue TO, allowing the target strand to interact with the seed sequence of the crRNA. The non-target strand nucleotides dT1*-dT5* interact with the Arg692-Ser702 loop in FnCas12a through hydrogen-bonding and ionic interactions between backbone phosphate groups and side chains of Arg692, Asn700, Ser702, and Gln704, as well as main-chain amide groups of Lys699, Asn700, and Ser702. Alanine substitution of Q704 or replacement of residues Thr698-Ser702 in FnCas12a with the sequence Ala-Gly3 substantially reduced DNA cleavage activity, suggesting that these residues contribute to R-loop formation by stabilizing the displaced conformation of the nontarget DNA strand.

In the FnCas12a R-loop complex, the crRNA-target strand heteroduplex is terminated by a stacking interaction with a conserved aromatic residue (Tyr410). This prevents base pairing between the crRNA and the target strand beyond nucleotides U20 and dA(−20), respectively. Beyond this point, the target DNA strand nucleotides re-engage the non-target DNA strand, forming a PAM-distal DNA duplex comprising nucleotides dC(−21)-dA(−27) and dG21*-dT27*, respectively. The duplex is confined between the REC2 and Nuc domains at the end of the central channel formed by theREC and NUClobes.

Target DNA cleavage: FnCpf1 can independently accommodate both the target and non-target DNA strands in the catalytic pocket of the RuvC domain. The RuvC active site contains three catalytic residues (D917, E1006, and D1255). Structural observations suggest that both the target and non-target DNA strands are cleaved by the same catalytic mechanism in a single active site in Cas12a enzymes.

AsCpf1

Structural characteristics of AsCpf1 include those described in Yamano et al., Crystal structure of Cpf1 in complex with guide RNA and target DNA, Cell 165, 949-962, May 5, 2016.

Overallstructure: AsCpf1 adopts a bilobed architecture consisting of an a-helical recognition (REC) lobe and a nuclease (NUC) lobe, with the crRNA-target DNA heteroduplex bound to the positively charged, central channel between the two lobes. The REC lobe consists of the REC1 and REC2 domains, whereas the NUC lobe consists of the RuvC domain and three additional domains, denoted A, B, and C. The REC1 domain comprises 13 α helices, and the REC2 domain comprises ten a helices and two β strands that form a small antiparallel sheet. Domains A and B play functional roles similar to those of the WED(Wedge) and PI (PAM-interacting) domains of Cas9 (Anders et al., 2014; Nishimasu et al., 2015; Hirano et al., 2016). Domain C is involved in DNA cleavage. Thus, domains A, B, and C are referred to as theWED,PI, and Nuc domains, respectively. The WED domain is assembled from three separate regions (WED-I-III) in the Cpf1 sequence. The WED domain can be divided into a core subdomain comprising a nine-stranded, distorted antiparallel β sheet (β1-β8 and β11) flanked by seven a helices (α1-α6 and α9) and a subdomain comprising two β strands (β9 and β10) and two α helices (α7 and α8). The PI domain comprises seven a helices (α1-α7) and a 1 hairpin (β1 and β2) and is inserted between the WED-II and WED-III regions, whereas the REC lobe is inserted between the WED-I and WED-II regions. The RuvC domain contains the three motifs (RuvC—I-III) that form the endonuclease active center. A characteristic helix (referred to as the bridge helix) is located between the RuvC-I and RuvC-II motifs and connects the REC and NUC lobes. The Nuc domain is inserted between the RuvC-II and RuvC-III motifs.

crRNA and DNA target recognition: The 5' handle of the crRNA is bound at the groove between the WED and RuvC domains. The U(−1),U(−16) base pair in the 5' handle is recognized by the WED domain in a base-specific manner. U(−1) and U(−16) hydrogen bond with His761 and Argl8/Asn759, respectively, while U(−1) stacks on His761. The N6 of A(−19) hydrogen bonds with Leu807 and Asn808, while the base moieties of A(−18) and A(−19) form stacking interactions with Ile858 and Met806, respectively. Moreover, the phosphodiester backbone of the 5' handle forms an extensive network of interactions with the WED and RuvC domains.

Recognition of the crRNA-target DNA heteroduplex: The crRNA-target DNA heteroduplex is accommodated within the positively charged, central channel formed by the REC1, REC2, and RuvC domains and is recognized by the protein in a sequence-independent manner. The PAM-distal and PAM-proximal regions of the heteroduplex are recognized by the REC1-REC2 domains and the WED-REC1-RuvC domains, respectively. Arg951 and Arg955 in the bridge helix interact with the sugar-phosphate backbone of the target DNA strand. Notably, the sugar-phosphate backbone of the nucleotides G1-A8 in the crRNA forms multiple contacts with the WED and REC1 domains, and the base pairing within the 5-bp PAM-proximal "seed" region is important for Cpf1-mediated DNA cleavage. In addition, the backbone phosphate group between dT(−1) and dC1 of the target DNA strand (referred to as the +1 phosphate) is recognized by the side chain of Lys780 and the main-chain amide group of Gly783. This interaction results in the rotation of the +1 phosphate group, thereby facilitating base pairing between dC1 in the target DNA strand and G1 in the crRNA. The residues involved in the heteroduplex recognition are conserved in most members of the Cpf1 family (Zetsche et al., 2015), and the R176A, R192A, G783P, and R951A mutants exhibited reduced activities, confirming their functional relevance.

Cpf1 recognizes the 20-bp RNA-DNA heteroduplex. The side chain of Trp382 in the REC2 domain forms a stacking interaction with the C20:dG20 base pair in the heteroduplex and thus prevents base pairing between A21 and dT21. Indeed, the W382A mutant showed reduced activity, highlighting its functional importance.

PAM recognition: The PAM duplex adopts a distorted conformation with a narrow minor groove and is bound to the groove formed by the WED, REC1, and PI domains. The PAM duplex is recognized by the WED-REC1 and PI domains from the major and minor groove sides, respectively. The dT(−1):dA(−1*) base pair in the PAM duplex does not form base-specific contacts with the protein, consistent with the lack of specificity in the fourth position of the 5'-TTTN-3' PAM. Lys607 in the PI domain is inserted into the narrow minor groove and plays critical roles in the PAM recognition. The O2 of dT(−2*) forms a hydrogen bond with the side chain of Lys607, whereas the nucleobase and deoxyribose moieties of dA(−2) form van der Waals interactions with the side chains of Lys607 and Pro599/Met604, respectively. The 5-methyl group of dT(−3*) forms a van der Waals interaction with the side-chain methyl group of Thr167, whereas the N3 and N7 of dA(−3) form hydrogen bonds with Lys607 and Lys548, respectively. The 5-methyl group of dT(−4*) is surrounded by the side-chain methyl groups of Thr167 and Thr539, whereas the O4' of dA(−4) forms a hydrogen bond with the side chain of Lys607. Notably, the N3 and O4 of dT(−4*) form hydrogen bonds with the N1 of dA(−4) and the N6 of dA(−3), respectively. The K548A and M604A mutants exhibited reduced activities, confirming that Lys548 and Met604 participate in the PAM recognition. Further, the K607A mutant showed almost no activity, indicating that Lys607 is critical for the PAM recognition.

Nuclease domains: The RuvC domain comprises a typical RNase H fold, consisting of a five-stranded mixed β sheet (β1-β5) flanked by three α helices (α1-α3), and two additional helices and three β strands. The conserved, negatively charged residues Asp908, Glu993, and Asp1263 form an active site. The D908A and E993A mutants had almost no activity, whereas the D1263A mutant exhibited significantly reduced activity, confirming the roles of Asp908, Glu993, and Asp1263 in DNA cleavage. Notably, the bridge helix is inserted between strand β3 and helix α1 in the RNase H fold and interacts with the REC2 domain. The main-chain carbonyl group of Gln956 in the bridge helix forms a hydrogen bond with the side chain of Lys468 in the REC2 domain. In addition, Trp958 in the RuvC domain is accommodated in the hydrophobic pocket formed by Leu467, Leu471, Tyr514, Arg518, Ala521, and Thr522 in the REC2 domain. These observations highlight the functional importance of the bridge helix-mediated interaction between the REC and NUC lobes.

The crystal structure revealed the presence of the Nuc domain, which is inserted between the RuvC-II (strand β5) and RuvC-III (helix α3) motifs in the RuvC domain. The Nuc domain is connected to the RuvC domain via two linker loops (referred to as L1 and L2). The Nuc domain comprises five α helices and nine β strands and lacks detectable structural or sequence similarity to any known nucleases or proteins. Notably, the conserved polar residues Arg1226 and Asp1235 and the partially conserved Ser1228 are clustered in the proximity of the active site of the RuvC domain. The S1228A mutant showed DNA cleavage activity comparable to that of wild-type AsCpf1. In contrast, the D1235A mutant exhibited reduced activity, whereas the R1226A mutant showed almost no activity, indicating that Arg1226 is critical for DNA cleavage. Further characterization revealed that the R1226A mutant acts as a nickase that cleaves the non-target DNA strand, but not the target strand, indicating that the Nuc and RuvC domains cleave the target and non-target DNA strands, respectively. The mutations of the catalytic residues in the AsCpf1 RuvC domain abolished the cleavage of both DNA strands, suggesting that the cleavage of the non-target strand by the RuvC domain is a prerequisite for the target strand cleavage by the Nuc domain.

LbuCas13a

Structural characteristics of LbuCas13a include those described in Liu et al., The molecular architecture for RNA-guided RNA cleavage by Cas13a, Cell 170, 714-726, Aug. 10, 2017.

Overall structure: LbuCas13a adopts a bilobed architecture consisting of an α-helical REC lobe and a NUC lobe, with the repeat region of the crRNA anchored in the REC lobe and the guide-target RNA duplex bound within the channel in the NUC lobe. The REC lobe consists of the NTD and Helical-1 domains, and the NUC lobe comprises two conserved HEPN domains, a Linker and the Helical-2 domain. The Helical-1 domain in LbuCas13a is comprised of ten α helices, while the HEPN1 domain is composed of two HEPN1 motifs (HEPN1 I-II) connected by the helical-2 domain. The Linker, which connects the two HEPN domains, is 133 amino acids in length.

crRNA-target RNA duplex recognition: The 28-bp guide-target RNA duplex is accommodated within a positively charged, central channel within the NUC lobe. The NUC lobe forms a nearly closed half-fist architecture with the duplex lying in the cleft between the fingers and the palm. Two α helices of the Linker domain and a β-hairpin of the HEPN2 domain extend over the channel to the Helical-2 domain, acting to lock the RNA duplex into the binding channel, like a thumb positioned on the fingers locks a half-fist. Base pairs 1-24 in the duplex are mostly surrounded by the NUC lobe, being primarily stabilized by the Helical-2 domain, the HEPN1 domain, and Linker region in a sequence-independent manner.

The guide region forms multiple contacts with LbuCas13a. The bases are splayed apart at the C(−1)-A1 step in the crRNA, with the Watson-Crick base pair A1.U10 stacking onto the side chains of Lys5 and Lys2 and the C(−1) base stacking on the A(−8) base. The sugar-phosphate backbone of crRNA nucleotides U8-A15 forms extensive contacts with the Helical-2, Linker, and HEPN1 domains. Notably, the alanine substituted for Lys558, which contacts the phosphate group of the eighth guide nucleotide, dramatically reduced crRNA-guided RNA cleavage by LbuCas13a, indicating its functional importance. The Tyr601Ala, Arg809Ala, Lys942Ala, and Tyr938Ala mutants also showed reduced target RNA cleavage activity, confirming their functional relevance. In addition, the phosphate-sugar backbone of nucleotides 18-24 in the guide strand make contacts with the Helical-2 and Linker domains, and Lys718Ala and Lys845Ala mutants showed reduced target RNA cleavage activity, suggesting that interactions between the guide and LbuCas13a play critical roles in the crRNA-guided RNA cleavage.

The target RNA strand mainly interacts with the Helical-2, Linker, and HEPN1 domains via the sugar-phosphate backbone of nucleotides G1'0-A21'0. Nucleotides G2'0 and U3'0 within the target RNA contact the side chains of Arg41 and Lys86 within the NTD domain. The Arg1135Ala and Gln519Ala mutants exhibit reduced cleavage activities, suggesting that interactions between target RNA and LbuCas13a are essential for crRNA-guided RNA cleavage.

Enzyme activation: The two conserved HEPN domains of LbuCas13a are folded closely together to form a concave surface containing the catalytic site for RNA-guided RNA cleavage. The activate site is composed of catalytic residues Arg472 and His477 from HEPN1 and Arg1048 and His1053 from HEPN2. Cas13a is able to cleave target RNA with a complementary sequence, as well as collateral RNA upon target RNA binding. The LbuCas13a crRNA-target RNA ternary complex has an active catalytic site, with the catalytic residues being located in close proximity, whereas the HEPN catalytic site of the crRNA-bound binary complex is maintained in a catalytically inactive state, with the catalytic residues located far apart from each other. In effect, the target RNA is an activator, activating the catalytic site within the two HEPN domains by forming a duplex with the guide region of the crRNA and bringing the catalytic residues into close proximity. The activated HEPN catalytic site likely cleaves ssRNA non-specifically.

RNA cleavage: In the LbuCas13a-crRNA-target RNA ternary complex, the nucleotide G290 in the target RNA strand, immediately upstream of the dsRNA duplex, is flipped out of the helical stack, pointing directly away from the duplex. Intriguingly, nucleotide G290 inserts into the HEPN catalytic site of the neighboring LbuCas13a (the second complex in the same asymmetric unit [ASU]). The base of G290 is held in place by residues Phe995 and His473, through aromatic stacking, and His477 and Gln1007 of the neighboring LbuCas13a molecule via hydrogen bonds. In addition, a β-hairpin within the HEPN1 domain from this neighboring LbuCas13a extends into the major groove of the guide-target RNA duplex, enhancing the contacts between the neighboring LbuCas13a and the target RNA by Van der Waals interaction. Substitution of residues His473, Phe995, Asn997, and Lys998 with alanine significantly reduced the cleavage of both target and non-target ssRNA substrate, and truncation of this β-hairpin reduces the ssRNA cleavage suggesting that the interaction between the target RNA and the HEPN domains is essential for cleavage.

crRNA processing: Cas13a cleaves pre-crRNA between nucleotides A(−31) and G(−30), generating mature crRNA using a cleavage site that is distinct from that used in RNA-guided ssRNA cleavage. Interactions between nucleotides (−31)-(−30) and the HEPN2 domain are essential for pre-crRNA processing. Five nucleotides G(_31)-C(_27) can be observed in the binary complex, but G(−31) is disordered in the ternary complex. The 5'-flank (nucleotides from G[-31] to C[-27]) is flipped out of the helical stack of the crRNA stem and points in a direction at right angles to that of nucleotide A(−26). The 5'-handle lies in the cleft formed between the Helical-1 and HEPN2 domains. The base G(−29) stacks on the side chain of Ilel104, resulting in a link between nucleotides A(−29)-G(−30). The phosphate group between nucleotides A(−29) and G(−30) is stabilized by Lys319 and Arg322 within the Helical-1 domain and base G(−30) stacks on the side chain of Arg322. A single-point mutation at residue Arg322 reduced pre-crRNA processing, and mutations at residues Lys319 and Lys321 had minimal effect. The phosphate group between nucleotide G(−31) and G(−30) contacts the side chains of Arg1072, Arg1079, and Lys1082 via hydrogen bonds and electronic interactions, suggesting that these amino acids play important roles for pre-crRNA processing. The side chain of Lys1108 is located near the nucleotide G(−31). Of note, single-point mutations of Arg1079 and Lys1108 abolished pre-crRNA cleavage, and mutation of Arg1072 and Lys1082 significantly reduced cleavage. Removal of the side chains of Arg1079, Arg1072, and Lys1082 significantly reduce pre-crRNA cleavage.

BthC2c1

Structural characteristics of BthC2c1 include those described in Wu et al., Structural basis of stringent PAM recognition by CRISPR-C2c1 in complex with sgRNA, Cell Research 27, 705-708 (2017).

Overallstructure: BthC2c1 has a bi-lobed architecture composed of an a-helical recognition (REC) lobe and a nuclease (NUC) lobe. The REC lobe consists of a PAM-interacting (PI) domain, a REC1 domain, a REC2 domain, and a long a helix referred to as the bridge helix (BH). The NUC lobe contains an OBD domain, a RuvC domain, and a domain with unknown functions (termed "UK" domain). The RuvC domain in the NUC lobe, composed by three split RuvC motifs (RuvC I-III), interfaces with the REC2 domain in the REC lobe. The interaction between the RuvC domain and REC1 domain is mainly mediated by the UK domain. The α helix of BH forms α-helical bundle with those of the REC2 domain to recognize the sgRNA and target DNA heteroduplex at one side. The other side of the heteroduplex is recognized by the REC2 domain. to form a positively charged surface that interacts with the 3' tail of the sgRNA.

sgRNA:target DNA heteroduplex recognition: The PI domain and the N-terminal region of the REC1 domain interact with the PAM-proximal region of the heteroduplex, whereas the C-terminal regions of the REC1 and REC2 domains interact with the PAM-distal region of the heteroduplex. The negatively charged sgRNA:target DNA heteroduplex is accommodated in the positively charged channel at the interface formed by REC and NUC lobes. Recognition of the sgRNA:target DNA heteroduplex by BthC2c1 is mainly through interactions between sugar-phosphate backbone and the protein. The PAM-distal region (A13-U19) of the sgRNA interacts with the two REC domains (Lys752, Arg768, Val767, Gly765, Asp279, Tyr333, Gln323, and Lys320), whereas the sugar-phosphate backbone of the target DNA sequence (dT(13')-dA(19')) complementary to that of PAM-distal guide segment is extensively recognized by the two REC domains (Arg769, Arg272, Thr280, Asn282, Arg294, and Arg328) and the RuvC domain (Arg841). The repeat:anti-repeat duplex containing an anticipated base-pairing segment (U(−6):G(−25)-G(−13):C(−18)) and an unanticipated base-pairing segment (C(−1):G(−61)-A(−5):U(−57)), is recognized by OBD (Glu412, Lys415, Leu414, Lys413, Asn452, Try451, Arg448, Arg507, and Lys9) and REC2 (Lys813, Tyr808, Lys794, Trp815, Lys793, Asn743, His783, and Asp790) domains.

PAM recognition: The 5'-ATTC-3' PAM duplex is sandwiched between the OBD and PI domains. The OBD domain consists of a β-sheet barrel flanked by four short-helices, whereas the PI domain is composed of a bundle of four α-helices connected by linkers and loop PL1 (Ser129-Arg143). The loop PL1 deeply inserts into the minor groove of PAM duplex and interacts with the target and non-target DNA strands. Ser137, Lysl41, and Arg140 from the loop PL1 hydrogen-bonds with the sugar-phosphate backbone of dC(−6'), dC(−5'), and dA(−2'), respectively. The sugar-phosphate backbone of PAM in the non-target DNA strand is recognized by Ser211, Val212, Ser129, Gln130, Gly132, Trp162, and Arg143 via hydrogen-bonding interactions. The O2 and O4 of dT(−2*) and the O6 of dG(−1') form hydrogen bonds with Arg140 and Asn118, respectively. In addition, the N3 of dA(−2') is also recognized by the side chain of Arg140. Another loop (L1, residues Ser395-Asn400) from OBD recognizes the PAM duplex from the major groove side, through the hydrogen bonds between Ser397 and the N6 of dA(−4*), and N6 and N7 of dA(−3'), and those between Asn398 and N6 of dA(−3'), and N6 and N7 of dA(−2). Mutations of these PI residues largely reduced the DNA cleavage activity of BthC2c1 in vitro, further supporting the structural observation. In addition, residues Ser138 and Gly139 from loop PL1 are located right at the bottom of the minor groove of PAM duplex. Replacement of them by bulkier residues could cause steric repulsion between loop PL1 and PAM bases; indeed, the S138Y and G139T mutations significantly impaired the DNA cleavage activity of BthC2c1. These structural and biochemical data indicate that BthC2c1 has stringent specificity for PAM.

Stem loop recognition: The phosphate backbone of stem loop 1 (C(−74)-G(−104)) is recognized by the REC, BH, RuvC, and UK domains. The flipped-out bases of A(−100) and G(−99) are recognized by Lys619 via hydrogen-bonding and Tyr808 via stacking interaction, respectively. G(−86) is extensively recognized by Arg613, His802, and Asn819. Stem loop 1 does not affect the cleavage activity of BthC2c1; in vitro cleavage assay confirmed that the DNA cleavage activity of BthC2c1 guided by a stem loop 1-truncated sgRNA is comparable to that of full-length sgRNA, whereas BthC2c1 guided by an sgRNA with longer truncation (33-end) failed to efficiently cleave substrate DNA. In addition, tetraloop is also not necessary for BthC2c1's cleavage activity; the DNA cleavage activity of BthC2c1 guided by a tetraloop-truncated-mutant sgRNA (A85-92/GAA) is comparable to that of full-length sgRNA.

Methods for Identifying New CRISPR-Cas Loci

The Cpf1 gene is found in several diverse bacterial genomes, typically in the same locus with cas1, cas2, and cas4 genes and a CRISPR cassette (for example, FNFX1_1431-FNFX1_1428 of *Francisella* cf. *novicida* Fx1). Thus, the layout of this novel CRISPR-Cas system appears to be similar to that of type II-B. Furthermore, similar to Cas9, the Cpf1 protein contains a readily identifiable C-terminal region that is homologous to the transposon ORF-B and includes an active RuvC-like nuclease, an arginine-rich region, and a Zn finger (absent in Cas9). However, unlike Cas9, Cpf1 is also present in several genomes without a CRISPR-Cas context and its relatively high similarity with ORF-B suggests that it might be a transposon component. It was suggested that if this was a genuine CRISPR-Cas system and Cpf1 is a functional analog of Cas9 it would be a novel CRISPR-Cas type, namely type V (See Annotation and Classification of CRISPR-Cas Systems. Makarova KS, Koonin EV. Methods Mol Biol. 2015; 1311:47-75). However, as described herein, Cpf1 is denoted to be in subtype V-A to distinguish it from C2c1p which does not have an identical domain structure and is hence denoted to be in subtype V-B. The application describes methods for using CRISPR-Cas proteins in therapy. This is exemplified herein with Cpf1, whereby a number of Cpf1 orthologs or homologs have been identified. It will be apparent to the skilled person that further Cpf1 orthologs or homologs can be identified and that any of the functionalities described herein may be engineered into other Cpf1 orthologs, including chimeric enzymes comprising fragments from multiple orthologs.

For instance, computational methods of identifying novel CRISPR-Cas loci are described in EP3009511 or US2016208243 and may comprise the following steps: detecting all contigs encoding the Cas1 protein; identifying all predicted protein coding genes within 20 kB of the cas1 gene; comparing the identified genes with Cas protein-specific profiles and predicting CRISPR arrays; selecting unclassified candidate CRISPR-Cas loci containing proteins larger than 500 amino acids (>500 aa); analyzing selected candidates using methods such as PSI-BLAST and HHPred to screen for known protein domains, thereby identifying novel Class 2 CRISPR-Cas loci (see also Schmakov et al. 2015, Mol Cell. 60(3):385-97). In addition to the above mentioned steps, additional analysis of the candidates may be conducted by searching metagenomics databases for additional homologs. Additionally or alternatively, to expand the search to non-autonomous CRISPR-Cas systems, the same procedure can be performed with the CRISPR array used as the seed.

In one aspect the detecting all contigs encoding the Cas1 protein is performed by GenemarkS which a gene prediction program as further described in "GeneMarkS: a self-training method for prediction of gene starts in microbial genomes. Implications for finding sequence motifs in regulatory regions." John Besemer, Alexandre Lomsadze and Mark Borodovsky, Nucleic Acids Research (2001) 29, pp 2607-2618, herein incorporated by reference.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats", Edgar, R. C., BMC Bioinformatics, January 20; 8:18(2007), herein incorporated by reference.

In a further aspect, the case by case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case by case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELLER software from HHpred alignments.

In certain example embodiments, methods for identifying novel CRISPR loci may include comparison to properties and elements of known CRISPR loci. Example methods are disclosed in U.S. Provisional Application No. 62/376,387 filed Aug. 17, 2016 and entitled "Methods for identifying Class 2 CRISPR-Cas systems," U.S. Provisional Application No. 62/376,383 filed Aug. 17, 2016 and entitled "Methods for Identifying Novel Gene Editing Elements," and Shmakov et al. "Diversity and evolution of class 2 CRISPR-Cas systems," Nat Rev Microbiol. 2017 15(3):169-182. Finally, methods such as those disclosed above may also be adaptive to identify genomic structures comprising repeating motifs in general as opposed to specific known CRISPR objects such as Cas9 or Cpf1.

It should be further recognized that putative novel CRISPR-Cas loci may be further discovered and or integrated, in particular for relevant nuclease activity, using the methods disclosed in the section below under the header "Methods for determining on/off target activity and selecting suitable sequences/guides."

Determination of PAM

Determination of PAM can be ensured as follows This experiment closely parallels similar work in *E. coli* for the heterologous expression of StCas9 (Sapranauskas, R. et al. Nucleic Acids Res 39, 9275-9282 (2011)). Applicants introduce a plasmid containing both a PAM and a resistance gene into the heterologous *E. coli*, and then plate on the corresponding antibiotic. If there is DNA cleavage of the plasmid, Applicants observe no viable colonies.

In further detail, the assay is as follows for a DNA target. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12 h after transformation, all colonies formed by the test and control strains where harvested and plasmid DNA was isolated. Plasmid DNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM.

Codon Optimized Nucleic Acid Sequences

The proteins (e.g., Cas proteins) herein may be codon optimized. Where the effector protein is to be administered as a nucleic acid, the application envisages the use of codon-optimized Cas. An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein is within the ambit of the skilled artisan). Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. As to codon usage in yeast, reference is made to the online Yeast Genome database available at www.yeastgenome.org/community/codon_usage.shtml, or Codon selection in yeast, Bennetzen and Hall, J Biol Chem. 1982 Mar. 25; 257(6): 3026-31. As to codon usage in plants including algae, reference is made to Codon usage in higher plants, green algae, and cyanobacteria, Campbell and Gowri, Plant Physiol. 1990 January; 92(1): 1-11.; as well as Codon usage in plant genes, Murray et al, Nucleic Acids Res. 1989 Jan.

25; 17(2):477-98; or Selection on the codon bias of chloroplast and cyanelle genes in different plant and algal lineages, Morton B R, J Mol Evol. 1998 April; 46(4):449-59.

Modified Cas Proteins

Modified Cpf1

In particular embodiments, it is of interest to make use of an engineered Cpf1 protein as defined herein, such as Cpf1, wherein the protein complexes with a nucleic acid molecule comprising RNA to form a CRISPR complex, wherein when in the CRISPR complex, the nucleic acid molecule targets one or more target polynucleotide loci, the protein comprises at least one modification compared to unmodified Cpf1 protein, and wherein the CRISPR complex comprising the modified protein has altered activity as compared to the complex comprising the unmodified Cpf1 protein. It is to be understood that when referring herein to CRISPR "protein", the Cpf1 protein preferably is a modified CRISPR enzyme (e.g. having increased or decreased (or no) enzymatic activity, such as without limitation including Cpf1. The term "CRISPR protein" may be used interchangeably with "CRISPR enzyme", irrespective of whether the CRISPR protein has altered, such as increased or decreased (or no) enzymatic activity, compared to the wild type CRISPR protein.

Computational analysis of the primary structure of Cpf1 nucleases reveals three distinct regions. First a C-terminal RuvC like domain, which is the only functional characterized domain. Second a N-terminal alpha-helical region and third a mixed alpha and beta region, located between the RuvC like domain and the alpha-helical region.

Several small stretches of unstructured regions are predicted within the Cpf1 primary structure. Unstructured regions, which are exposed to the solvent and not conserved within different Cpf1 orthologs, are preferred sides for splits and insertions of small protein sequences. In addition, these sides can be used to generate chimeric proteins between Cpf1 orthologs.

In certain example embodiments, a modified Cpf1 protein comprises at least one modification that alters editing preference as compared to wild type. In certain example embodiments, the editing preference is for a specific insert or deletion within the target region. In certain example embodiments, the at least one modification increases formation of one or more specific indels. In certain example embodiments, the at least one modification is in a C-terminal RuvC like domain, the N-terminal alpha-helical region, the mixed alpha and beta region, or a combination thereof. In certain example embodiments the altered editing preference is indel formation. In certain example embodiments, the at least one modification increases formation of one or more specific insertions.

In certain example embodiments, the at least one modification increases formation of one or more specific insertions. In certain example embodiments, the at least one modification results in an insertion of an A adjacent to an A, T, G, or C in the target region. In another example embodiment, the at least one modification results in insertion of a T adjacent to an A, T, G, or C in the target region. In another example embodiment, the at least one modification results in insertion of a G adjacent to an A, T, G, or C in the target region. In another example embodiment, the at least one modification results in insertion of a C adjacent to an A, T, C, or G in the target region. The insertion may be 5' or 3' to the adjacent nucleotide. In one example embodiment, the one or more modification direct insertion of a T adjacent to an existing T. In certain example embodiments, the existing T corresponds to the 4th position in the binding region of a guide sequence. In certain example embodiments, the one or more modifications result in an enzyme which ensures more precise one-base insertions or deletions, such as those described above. More particularly, the one or more modifications may reduce the formations of other types of indels by the enzyme. The ability to generate one-base insertions or deletions can be of interest in a number of applications, such as correction of genetic mutants in diseases caused by small deletions, more particularly where HDR is not possible. For example correction of the F508del mutation in CFTR via delivery of three sRNA directing insertion of three T's, which is the most common genotype of cystic fibrosis, or correction of Alia Jafar's single nucleotide deletion in CDKL5 in the brain. As the editing method only requires NHEJ, the editing would be possible in post-mitotic cells such as the brain. The ability to generate one base pair insertions/deletions may also be useful in genome-wide CRISPR-Cas negative selection screens. In certain example embodiments, the at least one modification, is a mutation. In certain other example embodiment, the one or more modification may be combined with one or more additional modifications or mutations described below including modifications to increase binding specificity and/or decrease off-target effects.

In certain example embodiments, the engineered CRISPR-cas effector comprising at least one modification that alters editing preference as compared to wild type may further comprise one or more additional modifications that alters the binding property as to the nucleic acid molecule comprising RNA or the target polypeptide loci, altering binding kinetics as to the nucleic acid molecule or target molecule or target polynucleotide or alters binding specificity as to the nucleic acid molecule. Example of such modifications are summarized in the following paragraph. Based on the above information, mutants can be generated which lead to inactivation of the enzyme or which modify the double strand nuclease to nickase activity. In alternative embodiments, this information is used to develop enzymes with reduced off-target effects (described elsewhere herein)

In certain of the above-described Cpf1 enzymes, the enzyme is modified by mutation of one or more residues including but not limited to positions D917, E1006, E1028, D1227, D1255A, N1257, according to FnCpf1 protein or any corresponding ortholog. In an aspect the invention provides a herein-discussed composition wherein the Cpf1 enzyme is an inactivated enzyme which comprises one or more mutations selected from the group consisting of D917A, E1006A, E1028A, D1227A, D1255A, N1257A, D917A, E1006A, E1028A, D1227A, D1255A and N1257A according to FnCpf1 protein or corresponding positions in a Cpf1 ortholog. In an aspect the invention provides a herein-discussed composition, wherein the CRISPR enzyme comprises D917, or E1006 and D917, or D917 and D1255, according to FnCpf1 protein or a corresponding position in a Cpf1 ortholog.

In certain of the above-described Cpf1 enzymes, the enzyme is modified by mutation of one or more residues (in the RuvC domain) including but not limited to positions R909, R912, R930, R947, K949, R951, R955, K965, K968, K1000, K1002, K1003, K1009, K1017, K1022, K1029, K1035, K1054, K1072, K1086, R1094, K1095, K1109, K1118, K1142, K1150, K1158, K1159, R1220, R1226, R1242, and/or R1252 with reference to amino acid position numbering of AsCpf1 (*Acidaminococcus* sp. BV3L6).

In certain of the above-described non-naturally-occurring CRISPR enzymes, the enzyme is modified by mutation of one or more residues (in the RAD50) domain including but not limited positions K324, K335, K337, R331, K369, K370, R386, R392, R393, K400, K404, K406, K408, K414, K429, K436, K438, K459, K460, K464, R670, K675, R681, K686, K689, R699, K705, R725, K729, K739, K748, and/or K752 with reference to amino acid position numbering of AsCpf1 (*Acidaminococcus* sp. BV3L6).

In certain of the Cpf1 enzymes, the enzyme is modified by mutation of one or more residues including but not limited positions R912, T923, R947, K949, R951, R955, K965, K968, K1000, R1003, K1009, K1017, K1022, K1029, K1072, K1086, F1103, R1226, and/or R1252 with reference to amino acid position numbering of AsCpf1 (*Acidaminococcus* sp. BV3L6).

In certain embodiments, the Cpf1 enzyme is modified by mutation of one or more residues including but not limited positions R833, R836, K847, K879, K881, R883, R887, K897, K900, K932, R935, K940, K948, K953, K960, K984, K1003, K1017, R1033, R1138, R1165, and/or R1252 with reference to amino acid position numbering of LbCpf1 (Lachnospiraceae bacterium ND2006).

In certain embodiments, the Cpf1 enzyme is modified by mutation of one or more residues including but not limited positions K15, R18, K26, Q34, R43, K48, K51, R56, K84, K85, K87, N93, R103, N104, T118, K123, K134, R176, K177, R192, K200, K226, K273, K275, T291, R301, K307, K369, S404, V409, K414, K436, K438, K468, D482, K516, R518, K524, K530, K532, K548, K559, K570, R574, K592, D596, K603, K607, K613, C647, R681, K686, H720, K739, K748, K757, T766, K780, R790, P791, K796, K809, K815, T816, K860, R862, R863, K868, K897, R909, R912, T923, R947, K949, R951, R955, K965, K968, K1000, R1003, K1009, K1017, K1022, K1029, A1053, K1072, K1086, F1103, S1209, R1226, R1252, K1273, K1282, and/or K1288 with reference to amino acid position numbering of AsCpf1 (*Acidaminococcus* sp. BV3L6).

In certain embodiments, the enzyme is modified by mutation of one or more residues including but not limited positions K15, R18, K26, R34, R43, K48, K51, K56, K87, K88, D90, K96, K106, K107, K120, Q125, K143, R186, K187, R202, K210, K235, K296, K298, K314, K320, K326, K397, K444, K449, E454, A483, E491, K527, K541, K581, R583, K589, K595, K597, K613, K624, K635, K639, K656, K660, K667, K671, K677, K719, K725, K730, K763, K782, K791, R800, K809, K823, R833, K834, K839, K852, K858, K859, K869, K871, K872, K877, K905, R918, K921, K932, I960, K962, R964, R968, K978, K981, K1013, R1016, K1021, K1029, K1034, K1041, K1065, K1084, and/or K1098 with reference to amino acid position numbering of FnCpf1 (*Francisella novicida* U112).

In certain embodiments, the enzyme is modified by mutation of one or more residues including but not limited positions K15, R18, K26, R34, R43, K48, K51, R56, K83, K84, R86, K92, K102, K103, K116, K121, R158, E159, R174, R182, K206, K251, K253, K269, K271, K278, P342, K380, R385, K390, K415, K421, K457, K471, A506, R508, K514, K520, K522, K538, Y548, K560, K564, K580, K584, K591, K595, K601, K634, K640, R645, K679, K689, K707, T716, K725, R737, R747, R748, K753, K768, K774, K775, K785, K787, R788, Q793, K821, R833, R836, K847, K879, K881, R883, R887, K897, K900, K932, R935, K940, K948, K953, K960, K984, K1003, K1017, R1033, R1121, R1138, R1165, K1190, K1199, and/or K1208 with reference to amino acid position numbering of LbCpf1 (Lachnospiraceae bacterium ND2006).

In certain embodiments, the enzyme is modified by mutation of one or more residues including but not limited positions K14, R17, R25, K33, M42, Q47, K50, D55, K85, N86, K88, K94, R104, K105, K118, K123, K131, R174, K175, R190, R198, I221, K267, Q269, K285, K291, K297, K357, K403, K409, K414, K448, K460, K501, K515, K550, R552, K558, K564, K566, K582, K593, K604, K608, K623, K627, K633, K637, E643, K780, Y787, K792, K830, Q846, K858, K867, K876, K890, R900, K901, M906, K921, K927, K928, K937, K939, R940, K945, Q975, R987, R990, K1001, R1034, I1036, R1038, R1042, K1052, K1055, K1087, R1090, K1095, N1103, K1108, K1115, K1139, K1158, R1172, K1188, K1276, R1293, A1319, K1340, K1349, and/or K1356 with reference to amino acid position numbering of MbCpf1 (*Moraxella bovoculi* 237).

Recently a method was described for the generation of Cas9 orthologs with enhanced specificity (Slaymaker et al. 2015). This strategy can be used to enhance the specificity of Cpf1 orthologs. The following modifications are presently considered to provide enhanced Cpf1 specificity.

TABLE 7

Conserved Lysine and Arginine residues within RuvC.

| AsCpf1 | LbCpf1 |
|---|---|
| R912 | R833 |
| T923 | R836 |
| R947 | K847 |
| K949 | K879 |
| R951 | K881 |
| R955 | R883 |
| K965 | R887 |
| K968 | K897 |
| K1000 | K900 |
| R1003 | K932 |
| K1009 | R935 |
| K1017 | K940 |
| K1022 | K948 |
| K1029 | K953 |
| K1072 | K960 |
| K1086 | K984 |
| F1103 | K1003 |
| R1226 | K1017 |
| R1252 | R1033 |
|  | R1138 |
|  | R1165 |

Additional candidates are positive charged residues that are conserved between different orthologs (Table 8).

TABLE 8

Conserved Lysine and Arginine residues

| Residue | AsCpf1 | FnCpf1 | LbCpf1 | MbCpf1 |
|---|---|---|---|---|
| Lys | K15 | K15 | K15 | K14 |
| Arg | R18 | R18 | R18 | R17 |
| Lys/Arg | K26 | K26 | K26 | R25 |
| Lys/Arg | Q34 | R34 | K34 | K33 |
| Arg | R43 | R43 | R43 | M42 |
| Lys | K48 | K48 | K48 | Q47 |
| Lys | K51 | K51 | K51 | K50 |
| Lys/Arg | R56 | K56 | R56 | D55 |
| Lys/Arg | R84 | K87 | K83 | K85 |
| Lys/Arg | K85 | K88 | K84 | N86 |
| Lys/Arg | K87 | D90 | R86 | K88 |
| Arg | N93 | K96 | K92 | K94 |
| Lys/Arg | R103 | K106 | R102 | R104 |
| Lys | N104 | K107 | K103 | K105 |
| Lys | T118 | K120 | K116 | K118 |
| Lys/Arg | K123 | Q125 | K121 | K123 |
| Lys | K134 | K143 | — | K131 |
| Arg | R176 | R186 | R158 | R174 |
| Lys | K177 | K187 | E159 | K175 |
| Arg | R192 | R202 | R174 | R190 |

TABLE 8-continued

Conserved Lysine and Arginine residues

| Residue | AsCpf1 | FnCpf1 | LbCpf1 | MbCpf1 |
|---|---|---|---|---|
| Lys/Arg | K200 | K210 | R182 | R198 |
| Lys | K226 | K235 | K206 | I221 |
| Lys | K273 | K296 | K251 | K267 |
| Lys | K275 | K298 | K253 | Q269 |
| Lys | T291 | K314 | K269 | K285 |
| Lys/Arg | R301 | K320 | K271 | K291 |
| Lys | K307 | K326 | K278 | K297 |
| Lys | K369 | K397 | P342 | K357 |
| Lys | S404 | K444 | K380 | K403 |
| Lys/Arg | V409 | K449 | R385 | K409 |
| Lys | K414 | E454 | K390 | K414 |
| Lys | K436 | A483 | K415 | K448 |
| Lys | K438 | E491 | K421 | K460 |
| Lys | K468 | K527 | K457 | K501 |
| Lys | D482 | K541 | K471 | K515 |
| Lys | K516 | K581 | A506 | K550 |
| Arg | R518 | R583 | R508 | R552 |
| Lys | K524 | K589 | K514 | K558 |
| Lys | K530 | K595 | K520 | K564 |
| Lys | K532 | K597 | K522 | K566 |
| Lys | K548 | K613 | K538 | K582 |
| Lys | K559 | K624 | Y548 | K593 |
| Lys | K570 | K635 | K560 | K604 |
| Lys/Arg | R574 | K639 | K564 | K608 |
| Lys | K592 | K656 | K580 | K623 |
| Lys | D596 | K660 | K584 | K627 |
| Lys | K603 | K667 | K591 | K633 |
| Lys | K607 | K671 | K595 | K637 |
| Lys | K613 | K677 | K601 | E643 |
| Lys | C647 | K719 | K634 | K780 |
| Lys/Arg | R681 | K725 | K640 | Y787 |
| Lys/Arg | K686 | K730 | R645 | K792 |
| Lys | H720 | K763 | K679 | K830 |
| Lys | K739 | K782 | K689 | Q846 |
| Lys | K748 | K791 | K707 | K858 |
| Lys/Arg | K757 | R800 | T716 | K867 |
| Lys/Arg | T766 | K809 | K725 | K876 |
| Lys/Arg | K780 | K823 | K737 | K890 |
| Arg | R790 | R833 | R747 | R900 |
| Lys/Arg | P791 | K834 | R748 | K901 |
| Lys | K796 | K839 | K753 | M906 |
| Lys | K809 | K852 | K768 | K921 |
| Lys | K815 | K858 | K774 | K927 |
| Lys | T816 | K859 | K775 | K928 |
| Lys | K860 | K869 | K785 | K937 |
| Lys/Arg | R862 | K871 | K787 | K939 |
| Arg | R863 | K872 | R788 | R940 |
| Lys | K868 | K877 | Q793 | K945 |
| Lys | K897 | K905 | K821 | Q975 |
| Arg | R909 | R918 | R833 | R987 |
| Arg | R912 | R921 | R836 | R990 |
| Lys | T923 | K932 | K847 | K1001 |
| Lys/Arg | R947 | I960 | K879 | R1034 |
| Lys | K949 | K962 | K881 | I1036 |
| Arg | R951 | R964 | R883 | R1038 |
| Arg | R955 | R968 | R887 | R1042 |
| Lys | K965 | K978 | K897 | K1052 |
| Lys | K968 | K981 | K900 | K1055 |
| Lys | K1000 | K1013 | K932 | K1087 |
| Arg | R1003 | R1016 | R935 | R1090 |
| Lys | K1009 | K1021 | K940 | K1095 |
| Lys | K1017 | K1029 | K948 | N1103 |
| Lys | K1022 | K1034 | K953 | K1108 |
| Lys | K1029 | K1041 | K960 | K1115 |
| Lys | A1053 | K1065 | K984 | K1139 |
| Lys | K1072 | K1084 | K1003 | K1158 |
| Lys/Arg | K1086 | K1098 | K1017 | R1172 |
| Lys/Arg | F1103 | K1114 | R1033 | K1188 |
| Lys | S1209 | K1201 | K1121 | K1276 |
| Arg | R1226 | R1218 | R1138 | R1293 |
| Arg | R1252 | R1244 | R1165 | A1319 |
| Lys | K1273 | K1265 | K1190 | K1340 |
| Lys | K1282 | K1274 | K1199 | K1349 |
| Lys | K1288 | K1281 | K1208 | K1356 |

Table 8 provides the positions of conserved Lysine and Arginine residues in an alignment of Cpf1 nuclease from *Francisella novicida* U112 (FnCpf1), *Acidaminococcus* sp. BV3L6 (AsCpf1), Lachnospiraceae bacterium ND2006 (LbCpf1) and *Moraxella bovoculi* 237 (MbCpf1). These can be used to generate Cpf1 mutants with enhanced specificity.

With a similar strategy used to improve Cas9 specificity, specificity of Cpf1 can be improved by mutating residues that stabilize the non-targeted DNA strand. This may be accomplished without a crystal structure by using linear structure alignments to predict 1) which domain of Cpf1 binds to which strand of DNA and 2) which residues within these domains contact DNA.

However, this approach may be limited due to poor conservation of Cpf1 with known proteins. Thus it may be desirable to probe the function of all likely DNA interacting amino acids (lysine, histidine and arginine).

Positively charged residues in the RuvC domain are more conserved throughout Cpf1s than those in the Rad50 domain indicating that RuvC residues are less evolutionarily flexible. This suggests that rigid control of nucleic acid binding is needed in this domain (relative to the Rad50 domain). Therefore, it is possible this domain cuts the targeted DNA strand because of the requirement for RNA:DNA duplex stabilization (precedent in Cas9). Furthermore, more arginines are present in the RuvC domain (5% of RuvC residues 904 to 1307 vs 3.8% in the proposed Rad50 domains) suggesting again that RuvC targets the DNA strand complexed with the guide RNA. Arginines are more involved in binding nucleic acid major and minor grooves (Rohs et al. Nature (2009): Vol 461: 1248-1254). Major/minor grooves would only be present in a duplex (such as DNA:RNA targeting duplex), further suggesting that RuvC cuts the "targeted strand".

From these specific observations about AsCpf1 similar residues in Cpf1 may be identified from other species by sequence alignments. Alignments of AsCpf1 and FnCpf1, identify Rad50 binding domains and the Arginines and Lysines within.

Based on crystal structures of two similar domains as those found in Cpf1 (RuvC holiday junction resolvase and Rad50 DNA repair protein), it can be deduced what the relevant domains look like in Cpf1, and infer which regions and residues may contact DNA. In each structure residues are highlighted that contact DNA. The regions of AsCpf1 that correspond to these DNA binding regions are annotated. The list of residues in Table 9 are those found in the two binding domains.

TABLE 9 list of probable DNA interacting residues

| RuvC domain probable DNA interacting residues: AsCpf1 | Rad50 domain probable DNA interacting residues: AsCpf1 |
|---|---|
| R909 | K324 |
| R912 | K335 |
| R930 | K337 |
| R947 | R331 |
| K949 | K369 |
| R951 | K370 |
| R955 | R386 |
| K965 | R392 |
| K968 | R393 |
| K1000 | K400 |
| K1002 | K404 |
| R1003 | K406 |

TABLE 9-continued list of probable DNA interacting residues

| RuvC domain probable DNA interacting residues: AsCpf1 | Rad50 domain probable DNA interacting residues: AsCpf1 |
|---|---|
| K1009 | K408 |
| K1017 | K414 |
| K1022 | K429 |
| K1029 | K436 |
| K1035 | K438 |
| K1054 | K459 |
| K1072 | K460 |
| K1086 | K464 |
| R1094 | R670 |
| K1095 | K675 |
| K1109 | R681 |
| K1118 | K686 |
| K1142 | K689 |
| K1150 | R699 |
| K1158 | K705 |
| K1159 | R725 |
| R1220 | K729 |
| R1226 | K739 |
| R1242 | K748 |
| R1252 | K752 |
|  | R670 |

Deactivated/Inactivated Cpf1 Protein

Where the Cpf1 protein has nuclease activity, the Cpf1 protein may be modified to have diminished nuclease activity e.g., nuclease inactivation of at least 70%, at least 80%, at least 90%, at least 95%, at least 97%, or 100% as compared with the wild type enzyme; or to put in another way, a Cpf1 enzyme having advantageously about 0% of the nuclease activity of the non-mutated or wild type Cpf1 enzyme or CRISPR enzyme, or no more than about 3% or about 5% or about 10% of the nuclease activity of the non-mutated or wild type Cpf1 enzyme, e.g. of the non-mutated or wild type *Francisella novicida* U112 (FnCpf1), *Acidaminococcus* sp. BV3L6 (AsCpf1), Lachnospiraceae bacterium ND2006 (LbCpf1) or *Moraxella bovoculi* 237 (MbCpf1 Cpf1 enzyme or CRISPR enzyme. This is possible by introducing mutations into the nuclease domains of the Cpf1 and orthologs thereof.

In certain embodiments, the CRISPR enzyme is engineered and can comprise one or more mutations that reduce or eliminate a nuclease activity. The amino acid positions in the FnCpf1p RuvC domain include but are not limited to D917A, E1006A, E1028A, D1227A, D1255A, N1257A, D917A, E1006A, E1028A, D1227A, D1255A and N1257A. Applicants have also identified a putative second nuclease domain which is most similar to PD-(D/E)XK nuclease superfamily and HincII endonuclease like. The point mutations to be generated in this putative nuclease domain to substantially reduce nuclease activity include but are not limited to N580A, N584A, T587A, W609A, D610A, K613A, E614A, D616A, K624A, D625A, K627A and Y629A. In a preferred embodiment, the mutation in the FnCpf1p RuvC domain is D917A or E1006A, wherein the D917A or E1006A mutation completely inactivates the DNA cleavage activity of the FnCpf1 effector protein. In another embodiment, the mutation in the FnCpf1p RuvC domain is D1255A, wherein the mutated FnCpf1 effector protein has significantly reduced nucleolytic activity.

More particularly, the inactivated Cpf1 enzymes include enzymes mutated in amino acid positions As908, As993, As1263 of AsCpf1 or corresponding positions in Cpf1 orthologs. Additionally, the inactivated Cpf1 enzymes include enzymes mutated in amino acid position Lb832, 925, 947 or 1180 of LbCpf1 or corresponding positions in Cpf1 orthologs. More particularly, the inactivated Cpf1 enzymes include enzymes comprising one or more of mutations AsD908A, AsE993A, AsD1263A of AsCpf1 or corresponding mutations in Cpf1 orthologs. Additionally, the inactivated Cpf1 enzymes include enzymes comprising one or more of mutations LbD832A, E925A, D947A or D1180A of LbCpf1 or corresponding mutations in Cpf1 orthologs.

Mutations can also be made at neighboring residues, e.g., at amino acids near those indicated above that participate in the nuclease activity. In some embodiments, only the RuvC domain is inactivated, and in other embodiments, another putative nuclease domain is inactivated, wherein the effector protein complex functions as a nickase and cleaves only one DNA strand. In a preferred embodiment, the other putative nuclease domain is a HincII-like endonuclease domain. In some embodiments, two FnCpf1, AsCpf1 or LbCpf1 variants (each a different nickase) are used to increase specificity, two nickase variants are used to cleave DNA at a target (where both nickases cleave a DNA strand, while minimizing or eliminating off-target modifications where only one DNA strand is cleaved and subsequently repaired). In preferred embodiments the Cpf1 effector protein cleaves sequences associated with or at a target locus of interest as a homodimer comprising two Cpf1 effector protein molecules. In a preferred embodiment the homodimer may comprise two Cpf1 effector protein molecules comprising a different mutation in their respective RuvC domains.

The inactivated Cpf1 CRISPR enzyme may have associated (e.g., via fusion protein) one or more functional domains, including for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, MyoD1. In the event that Fok1 is provided, it is advantageous that multiple Fok1 functional domains are provided to allow for a functional dimer and that gRNAs are designed to provide proper spacing for functional use (Fok1) as specifically described in Tsai et al. Nature Biotechnology, Vol. 32, Number 6, June 2014). The adaptor protein may utilize known linkers to attach such functional domains. In some cases it is advantageous that additionally at least one NLS is provided. In some instances, it is advantageous to position the NLS at the N terminus. When more than one functional domain is included, the functional domains may be the same or different.

In general, the positioning of the one or more functional domain on the inactivated Cpf1 enzyme is one which allows for correct spatial orientation for the functional domain to affect the target with the attributed functional effect. For example, if the functional domain is a transcription activator (e.g., VP64 or p65), the transcription activator is placed in a spatial orientation which allows it to affect the transcription of the target. Likewise, a transcription repressor will be advantageously positioned to affect the transcription of the target, and a nuclease (e.g., Fok1) will be advantageously positioned to cleave or partially cleave the target. This may include positions other than the N-/C-terminus of the CRISPR enzyme.

Cas13 Truncations

In certain embodiments, the effector protein (CRISPR enzyme; Cas13; effector protein) according to the invention as described herein is a catalytically inactive or dead Cas13 effector protein (dCas13). In some embodiments, the dCas13 effector comprises mutations in the nuclease domain. In some embodiments, the dCas13 effector protein has been truncated.

To reduce the size of a fusion protein of the Cas13 effector and the one or more functional domains, the C-terminus of the Cas13 effector can be truncated while still maintaining its RNA binding function. For example, at least 20 amino acids, at least 40 amino acids, at least 50 amino acids, at least 60 amino acids, at least 80 amino acids, at least 100 amino acids, at least 120 amino acids, at least 140 amino acids, at least 150 amino acids, at least 160 amino acids, at least 180 amino acids, at least 200 amino acids, at least 220 amino acids, at least 240 amino acids, at least 250 amino acids, at least 260 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the C-terminus of the Cas13 effector. Specific examples of Cas13 truncations include C-terminal Δ984-1090, C-terminal Δ1026-1090, and C-terminal Δ1053-1090, C-terminal Δ934-1090, C-terminal Δ884-1090, C-terminal Δ834-1090, C-terminal Δ784-1090, and C-terminal Δ734-1090, wherein amino acid positions correspond to amino acid positions of *Prevotella* sp. P5-125 Cas13b protein. The skilled person will understand that similar truncations can be designed for other Cas13b orthologues, or other Cas13 types or subtypes, such as Cas13a, Cas13c, or Casl3d. In some cases, the truncated Cas13b is encoded by nt 1-984 of *Prevotella* sp.P5-125 Cas13b or the corresponding nt of a Cas13b orthologue or homologue. Examples of Cas13 truncations also include C-terminal Δ795-1095, wherein amino acid positions correspond to amino acid positions of *Riemerella anatipestifer* Cas13b protein. Examples of Cas13 truncations further include C-terminal Δ 875-1175, C-terminal Δ 895-1175, C-terminal Δ 915-1175, C-terminal Δ 935-1175, C-terminal Δ 955-1175, C-terminal Δ 975-1175, C-terminal Δ 995-1175, C-terminal Δ 1015-1175, C-terminal Δ 1035-1175, C-terminal Δ 1055-1175, C-terminal Δ 1075-1175, C-terminal Δ 1095-1175, C-terminal Δ 1115-1175, C-terminal Δ 1135-1175, C-terminal Δ 1155-1175, wherein amino acid positions correspond to amino acid positions of *Porphyromonas gulae* Cas13b protein.

In some embodiments, the N-terminus of the Cas13 effector protein may be truncated. For example, at least 20 amino acids, at least 40 amino acids, at least 50 amino acids, at least 60 amino acids, at least 80 amino acids, at least 100 amino acids, at least 120 amino acids, at least 140 amino acids, at least 150 amino acids, at least 160 amino acids, at least 180 amino acids, at least 200 amino acids, at least 220 amino acids, at least 240 amino acids, at least 250 amino acids, at least 260 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the N-terminus of the Cas13 effector. Examples of Cas13 truncations include N-terminal Δ1-125, N-terminal Δ 1-88, or N-terminal Δ 1-72, wherein amino acid positions of the truncations correspond to amino acid positions of *Prevotella* sp. P5-125 Cas13b protein.

In some embodiments, both the N- and the C-termini of the Cas13 effector protein may be truncated. For example, at least 20 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 40 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 60 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 80 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 100 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 120 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 140 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 160 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 180 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 200 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 220 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 240 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 260 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 280 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 300 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 350 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 20 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 40 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 60 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 80 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 100 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 120 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 140 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 160 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 180 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 200 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 220 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 240 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 260 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 280 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 300 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 350 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector.

Optimization of Crispr-Cas Systems

In another aspect, the present invention relates to methods for developing or designing CRISPR-Cas systems. In an aspect, the present invention relates to methods for developing or designing CRISPR-Cas system based therapy or therapeutics. The present invention in particular relates to methods for improving CRISPR-Cas systems, such as CRISPR-Cas system based therapy or therapeutics. Key characteristics of successful CRISPR-Cas systems, such as CRISPR-Cas system based therapy or therapeutics involve high specificity, high efficacy, and high safety. High specificity and high safety can be achieved among others by reduction of off-target effects.

Accordingly, in another aspect, the invention relates to a method as described herein, comprising selection of one or more (therapeutic) target, selecting one or more CRISPR-Cas system functionality, and optimization of selected parameters or variables associated with the CRISPR-Cas system and/or its functionality. In a related aspect, the invention relates to a method as described herein, comprising (a) selecting one or more (therapeutic) target loci, (b) selecting one or more CRISPR-Cas system functionalities, (c) optionally selecting one or more modes of delivery, and preparing, developing, or designing a CRISPR-Cas system selected based on steps (a)-(c).

In certain embodiments, CRISPR-Cas system functionality comprises genomic mutation. In certain embodiments, CRISPR-Cas system functionality comprises single genomic mutation. In certain embodiments, CRISPR-Cas system functionality comprises multiple genomic mutation. In certain embodiments, CRISPR-Cas system functionality comprises gene knockout. In certain embodiments, CRISPR-Cas system functionality comprises single gene knockout. In certain embodiments, CRISPR-Cas system functionality comprises multiple gene knockout. In certain embodiments, CRISPR-Cas system functionality comprises gene correction. In certain embodiments, CRISPR-Cas system functionality comprises single gene correction. In certain embodiments, CRISPR-Cas system functionality comprises multiple gene correction. In certain embodiments, CRISPR-Cas system functionality comprises genomic region correction. In certain embodiments, CRISPR-Cas system functionality comprises single genomic region correction. In certain embodiments, CRISPR-Cas system functionality comprises multiple genomic region correction. In certain embodiments, CRISPR-Cas system functionality comprises gene deletion. In certain embodiments, CRISPR- Cas system functionality comprises single gene deletion. In certain embodiments, CRISPR-Cas system functionality comprises multiple gene deletion. In certain embodiments, CRISPR-Cas system functionality comprises genomic region deletion. In certain embodiments, CRISPR-Cas system functionality comprises single genomic region deletion. In certain embodiments, CRISPR-Cas system functionality comprises multiple genomic region deletion. In certain embodiments, CRISPR-Cas system functionality comprises modulation of gene or genomic region functionality. In certain embodiments, CRISPR-Cas system functionality comprises modulation of single gene or genomic region functionality. In certain embodiments, CRISPR-Cas system functionality comprises modulation of multiple gene or genomic region functionality. In certain embodiments, CRISPR-Cas system functionality comprises gene or genomic region functionality, such as gene or genomic region activity. In certain embodiments, CRISPR-Cas system functionality comprises single gene or genomic region functionality, such as gene or genomic region activity. In certain embodiments, CRISPR-Cas system functionality comprises multiple gene or genomic region functionality, such as gene or genomic region activity. In certain embodiments, CRISPR-Cas system functionality comprises modulation gene activity or accessibility optionally leading to transcriptional and/or epigenetic gene or genomic region activation or gene or genomic region silencing. In certain embodiments, CRISPR-Cas system functionality comprises modulation single gene activity or accessibility optionally leading to transcriptional and/or epigenetic gene or genomic region activation or gene or genomic region silencing. In certain embodiments, CRISPR-Cas system functionality comprises modulation multiple gene activity or accessibility optionally leading to transcriptional and/or epigenetic gene or genomic region activation or gene or genomic region silencing.

The methods as described herein may further involve selection of the CRISPR-Cas system mode of delivery. In certain embodiments, gRNA (and tracr, if and where needed, optionally provided as a sgRNA) and/or CRISPR effector protein are or are to be delivered. In certain embodiments, gRNA (and tracr, if and where needed, optionally provided as a sgRNA) and/or CRISPR effector mRNA are or are to be delivered. In certain embodiments, gRNA (and tracr, if and where needed, optionally provided as a sgRNA) and/or CRISPR effector provided in a DNA-based expression system are or are to be delivered. In certain embodiments, delivery of the individual CRISPR-Cas system components comprises a combination of the above modes of delivery. In certain embodiments, delivery comprises delivering gRNA and/or CRISPR effector protein, delivering gRNA and/or CRISPR effector mRNA, or delivering gRNA and/or CRISPR effector as a DNA based expression system.

Accordingly, in an aspect, the invention relates to a method as described herein, comprising selection of one or more (therapeutic) target, selecting CRISPR-Cas system functionality, selecting CRISPR-Cas system mode of delivery, and optimization of selected parameters or variables associated with the CRISPR-Cas system and/or its functionality.

The methods as described herein may further involve selection of the CRISPR-Cas system delivery vehicle and/or expression system. Delivery vehicles and expression systems are described herein elsewhere. By means of example, delivery vehicles of nucleic acids and/or proteins include nanoparticles, liposomes, etc. Delivery vehicles for DNA, such as DNA-based expression systems include for instance biolistics, viral based vector systems (e.g. adenoviral, AAV, lentiviral), etc. the skilled person will understand that selection of the mode of delivery, as well as delivery vehicle or expression system may depend on for instance the cell or tissues to be targeted. In certain embodiments, the a delivery vehicle and/or expression system for delivering the CRISPR-Cas systems or components thereof comprises liposomes, lipid particles, nanoparticles, biolistics, or viral-based expression/delivery systems.

Accordingly, in an aspect, the invention relates to a method as described herein, comprising selection of one or more (therapeutic) target, selecting CRISPR-Cas system functionality, selecting CRISPR-Cas system mode of delivery, selecting CRISPR-Cas system delivery vehicle or expression system, and optimization of selected parameters or variables associated with the CRISPR-Cas system and/or its functionality.

Optimization of selected parameters or variables in the methods as described herein may result in optimized or improved CRISPR-Cas system, such as CRISPR-Cas system based therapy or therapeutic, specificity, efficacy, and/or safety. In certain embodiments, one or more of the following parameters or variables are taken into account, are selected, or are optimized in the methods of the invention as described herein: CRISPR effector specificity, gRNA specificity, CRISPR-Cas complex specificity, PAM restrictiveness, PAM type (natural or modified), PAM nucleotide content, PAM length, CRISPR effector activity, gRNA activity, CRISPR-Cas complex activity, target cleavage efficiency, target site selection, target sequence length, ability of effector protein to access regions of high chromatin accessibility, degree of uniform enzyme activity across genomic targets, epigenetic tolerance, mismatch/budge tolerance, CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector protein size, CRISPR effector expression level, gRNA expression level, CRISPR-Cas complex expression level, CRISPR effector spatiotemporal expression, gRNA spatiotemporal expression, CRISPR-Cas complex spatiotemporal expression.

In certain embodiments, selecting one or more CRISPCas system functionalities comprises selecting one or more of an optimal effector protein, an optimal guide RNA, or both.

In certain embodiments, selecting an optimal effector protein comprises optimizing one or more of effector protein type, size, PAM specificity, effector protein stability, immunogenicity or toxicity, functional specificity, and efficacy, or other CRISPR effector associated parameters or variables as described herein elsewhere.

In certain embodiments, the effector protein is a naturally occurring or modified effector protein.

In certain embodiments, the modified effector protein is a nickase, a deaminase, or a deactivated effector protein.

In certain embodiments, optimizing size comprises selecting a protein effector having a minimal size.

In certain embodiments, optimizing a PAM specificity comprises selecting an effector protein having a modified PAM specificity.

In certain embodiments, optimizing effector protein stability comprises selecting an effector protein having a short half-life while maintaining sufficient activity, such as by selecting an appropriate CRISPR effector orthologue having a specific half-life or stability.

In certain embodiments, optimizing immunogenicity or toxicity comprises minimizing effector protein immunogenicity or toxicity by protein modifications.

In certain embodiments, optimizing functional specific comprises selecting a protein effector with reduced tolerance of mismatches and/or bulges between the guide RNA and one or more target loci.

In certain embodiments, optimizing efficacy comprises optimizing overall efficiency, epigenetic tolerance, or both.

In certain embodiments, maximizing overall efficiency comprises selecting an effector protein with uniform enzyme activity across target loci with varying chromatin complexity, selecting an effector protein with enzyme activity limited to areas of open chromatin accessibility.

In certain embodiments, chromatin accessibility is measured using one or more of ATAC-seq, or a DNA-proximity ligation assay.

In certain embodiments, optimizing epigenetic tolerance comprises optimizing methylation tolerance, epigenetic mark competition, or both.

In certain embodiments, optimizing methylation tolerance comprises selecting an effector protein that modify methylated DNA.

In certain embodiments, optimizing epigenetic tolerance comprises selecting an effector protein unable to modify silenced regions of a chromosome, selecting an effector protein able to modify silenced regions of a chromosome, or selecting target loci not enriched for epigenetic markers In certain embodiments, selecting an optimized guide RNA comprises optimizing gRNA stability, gRNA immunogenicity, or both, or other gRNA associated parameters or variables as described herein elsewhere.

In certain embodiments, optimizing gRNA stability and/or gRNA immunogenicity comprises RNA modification, or other gRNA associated parameters or variables as described herein elsewhere. In certain embodiments, the modification comprises removing 1-3 nucleotides form the 3' end of a target complementarity region of the gRNA. In certain embodiments, modification comprises an extended gRNA and/or trans RNA/DNA element that create stable structures in the gRNA that compete with gRNA base pairing at a target of off-target loci, or extended complimentary nucleotides between the gRNA and target sequence, or both.

In certain embodiments, the mode of delivery comprises delivering gRNA and/or CRISPR effector protein, delivering gRNA and/or CRISPR effector mRNA, or delivery gRNA and/or CRISPR effector as a DNA based expression system. In certain embodiments, the mode of delivery further comprises selecting a delivery vehicle and/or expression systems from the group consisting of liposomes, lipid particles, nanoparticles, biolistics, or viral-based expression/delivery systems. In certain embodiments, expression is spatiotemporal expression is optimized by choice of conditional and/or inducible expression systems, including controllable CRISPR effector activity optionally a destabilized CRISPR effector and/or a split CRISPR effector, and/or cell- or tissue-specific expression system.

The above described parameters or variables, as well as means for optimization are described herein elsewhere. By means of example, and without limitation, parameter or variable optimization may be achieved as follows. CRISPR effector specificity may be optimized by selecting the most specific CRISPR effector. This may be achieved for instance by selecting the most specific CRISPR effector orthologue or by specific CRISPR effector mutations which increase specificity. gRNA specificity may be optimized by selecting the most specific gRNA. This may be achieved for instance by selecting gRNA having low homology, i.e. at least one or preferably more, such as at least 2, or preferably at least 3, mismatches to off-target sites. CRISPR-Cas complex specificity may be optimized by increasing CRISPR effector specificity and/or gRNA specificity as above. PAM restrictiveness may be optimized by selecting a CRISPR effector having to most restrictive PAM recognition. This may be achieved for instance by selecting a CRISPR effector orthologue having more restrictive PAM recognition or by specific CRISPR effector mutations which increase or alter PAM restrictiveness. PAM type may be optimized for instance by selecting the appropriate CRISPR effector, such as the appropriate CRISPR effector recognizing a desired PAM type. The CRISPR effector or PAM type may be naturally occurring or may for instance be optimized based on CRISPR effector mutants having an altered PAM recognition, or PAM recognition repertoire. PAM nucleotide content may for instance be optimized by selecting the appropriate CRISPR effector, such as the appropriate CRISPR effector recognizing a desired PAM nucleotide content. The CRISPR effector or PAM type may be naturally occurring or may for instance be optimized based on CRISPR effector mutants having an altered PAM recognition, or PAM recognition repertoire. PAM length may for instance be optimized by selecting the appropriate CRISPR effector, such as the appropriate CRISPR effector recognizing a desired PAM nucleotide length. The CRISPR effector or PAM type may be naturally occurring or may for instance be optimized based on CRISPR effector mutants having an altered PAM recognition, or PAM recognition repertoire. Target length or target sequence length may for instance be optimized by selecting the appropriate CRISPR effector, such as the appropriate CRISPR effector recognizing a desired target or target sequence nucleotide length. Alternatively, or in addition, the target (sequence) length may be optimized by providing a target having a length deviating from the target (sequence) length typically associated with the CRISPR effector, such as the naturally occurring CRISPR effector. The CRISPR effector or target (sequence) length may be naturally occurring or may for instance be optimized based on CRISPR effector mutants having an altered target (sequence) length recognition, or target (sequence) length recognition repertoire. For instance, increasing or decreasing target (sequence) length may influence target recognition and/or off-target recognition. CRISPR effector activity may be optimized by selecting the most active CRISPR effector. This may be achieved for instance by selecting the most active CRISPR effector orthologue or by specific CRISPR effector mutations which increase activity. The ability of the CRISPR effector protein to access regions of high chromatin accessibility, may be optimized by selecting the appropriate CRISPR effector or mutant thereof, and may take into account the size of the CRISPR effector, charge, or other dimensional variables etc. The degree of uniform CRISPR effector activity may be optimized by selecting the appropriate CRISPR effector or mutant thereof, and may take into account CRISPR effector specificity and/or activity, PAM specificity, target length, mismatch tolerance, epigenetic tolerance, CRISPR effector and/or gRNA stability and/or half-life, CRISPR effector and/or gRNA immunogenicity and/or toxicity, etc. gRNA activity may be optimized by selecting the most active gRNA. This may be achieved for instance by increasing gRNA stability through RNA modification. CRISPR-Cas complex activity may be optimized by increasing CRISPR effector activity and/or gRNA activity as above. The target site selection may be optimized by selecting the optimal position of the target site within a gene, locus or other genomic region. The target site selection may be optimized by optimizing target location comprises selecting a target sequence with a gene, locus, or other genomic region having low variability. This may be achieved for instance by selecting a target site in an early and/or conserved exon or domain (i.e. having low variability, such as polymorphisms, within a population). Alternatively, the target site may be selected by minimization of off-target effects (e.g. off-targets qualified as having 1-5, 1-4, or preferably 1-3 mismatches compared to target and/or having one or more PAM mismatches, such as distal PAM mismatches), preferably also taking into account variability within a population. CRISPR effector stability may be optimized by selecting CRISPR effector having appropriate half-life, such as preferably a short half-life while still capable of maintaining sufficient activity. This may be achieved for instance by selecting an appropriate CRISPR effector orthologue having a specific half-life or by specific CRISPR effector mutations or modifications which affect half-life or stability, such as inclusion (e.g. fusion) of stabilizing or destabilizing domains or sequences. CRISPR effector mRNA stability may be optimized by increasing or decreasing CRISPR effector mRNA stability. This may be achieved for instance by increasing or decreasing CRISPR effector mRNA stability through mRNA modification. gRNA stability may be optimized by increasing or decreasing gRNA stability. This may be achieved for instance by increasing or decreasing gRNA stability through RNA modification. CRISPR-Cas complex stability may be optimized by increasing or decreasing CRISPR effector stability and/or gRNA stability as above. CRISPR effector protein or mRNA immunogenicity or toxicity may be optimized by decreasing CRISPR effector protein or mRNA immunogenicity or toxicity. This may be achieved for instance by mRNA or protein modifications. Similarly, in case of DNA based expression systems, DNA immunogenicity or toxicity may be decreased. gRNA immunogenicity or toxicity may be optimized by decreasing gRNA immunogenicity or toxicity. This may be achieved for instance by gRNA modifications. Similarly, in case of DNA based expression systems, DNA immunogenicity or toxicity may be decreased. CRISPR-Cas complex immunogenicity or toxicity may be optimized by decreasing CRISPR effector immunogenicity or toxicity and/or gRNA immunogenicity or toxicity as above, or by selecting the least immunogenic or toxic CRISPR effector/gRNA combination. Similarly, in case of DNA based expression systems, DNA immunogenicity or toxicity may be decreased. CRISPR effector protein or mRNA dose or titer may be optimized by selecting dosage or titer to minimize toxicity and/or maximize specificity and/or efficacy. gRNA dose or titer may be optimized by selecting dosage or titer to minimize toxicity and/or maximize specificity and/or efficacy. CRISPR-Cas complex dose or titer may be optimized by selecting dosage or titer to minimize toxicity and/or maximize specificity and/or efficacy. CRISPR effector protein size may be optimized by selecting minimal protein size to increase efficiency of delivery, in particular for virus mediated delivery. CRISPR effector, gRNA, or CRISPR-Cas complex expression level may be optimized by limiting (or extending) the duration of expression and/or limiting (or increasing) expression level. This may be achieved for instance by using self-inactivating CRISPR-Cas systems, such as including a self-targeting (e.g. CRISPR effector targeting) gRNA, by using viral vectors having limited expression duration, by using appropriate promoters for low (or high) expression levels, by combining different delivery methods for individual CRISP-Cas system components, such as virus mediated delivery of CRISPR-effector encoding nucleic acid combined with non-virus mediated delivery of gRNA, or virus mediated delivery of gRNA combined with non-virus mediated delivery of CRISPR effector protein or mRNA. CRISPR effector, gRNA, or CRISPR-Cas complex spatiotemporal expression may be optimized by appropriate choice of conditional and/or inducible expression systems, including controllable CRISPR effector activity optionally a destabilized CRISPR effector and/or a split CRISPR effector, and/or cell- or tissue-specific expression systems.

In an aspect, the invention relates to a method as described herein, comprising selection of one or more (therapeutic) target, selecting CRISPR-Cas system functionality, selecting CRISPR-Cas system mode of delivery, selecting CRISPR-Cas system delivery vehicle or expression system, and optimization of selected parameters or variables associated with the CRISPR-Cas system and/or its functionality, optionally wherein the parameters or variables are one or more selected from CRISPR effector specificity, gRNA specificity, CRISPR-Cas complex specificity, PAM restrictiveness, PAM type (natural or modified), PAM nucleotide content, PAM length, CRISPR effector activity, gRNA activity, CRISPR-Cas complex activity, target cleavage efficiency, target site selection, target sequence length, ability of effector protein to access regions of high chromatin accessibility, degree of uniform enzyme activity across genomic targets, epigenetic tolerance, mismatch/budge tolerance, CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector protein size, CRISPR effector expression level, gRNA expression level, CRISPR-Cas complex expression level, CRISPR effector spatiotemporal expression, gRNA spatiotemporal expression, CRISPR-Cas complex spatiotemporal expression.

In an aspect, the invention relates to a method as described herein, comprising optionally selecting one or more (therapeutic) target, optionally selecting one or more CRISPR-Cas system functionality, optionally selecting one or more CRISPR-Cas system mode of delivery, optionally selecting one or more CRISPR-Cas system delivery vehicle or expression system, and optimization of selected parameters or variables associated with the CRISPR-Cas system and/or its functionality, wherein specificity, efficacy, and/or safety are optimized, and optionally wherein optimization of specificity comprises optimizing one or more parameters or variables selected from CRISPR effector specificity, gRNA specificity, CRISPR-Cas complex specificity, PAM restrictiveness, PAM type (natural or modified), PAM nucleotide content, PAM length, wherein optimization of efficacy comprises optimizing one or more parameters or variables selected from CRISPR effector activity, gRNA activity, CRISPR-Cas complex activity, target cleavage efficiency, target site selection, target sequence length, CRISPR effector protein size, ability of effector protein to access regions of high chromatin accessibility, degree of uniform enzyme activity across genomic targets, epigenetic tolerance, mismatch/budge tolerance, and wherein optimization of safety comprises optimizing one or more parameters or variables selected from CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector expression level, gRNA expression level, CRISPR-Cas complex expression level, CRISPR effector spatiotemporal expression, gRNA spatiotemporal expression, CRISPR-Cas complex spatiotemporal expression.

In an aspect, the invention relates to a method as described herein, comprising selecting one or more (therapeutic) target, selecting one or more CRISPR-Cas system functionality, selecting one or more CRISPR-Cas system mode of delivery, selecting one or more CRISPR-Cas system delivery vehicle or expression system, and optimization of selected parameters or variables associated with the CRISPR-Cas system and/or its functionality, wherein specificity, efficacy, and/or safety are optimized, and optionally wherein optimization of specificity comprises optimizing one or more parameters or variables selected from CRISPR effector specificity, gRNA specificity, CRISPR-Cas complex specificity, PAM restrictiveness, PAM type (natural or modified), PAM nucleotide content, PAM length, wherein optimization of efficacy comprises optimizing one or more parameters or variables selected from CRISPR effector activity, gRNA activity, CRISPR-Cas complex activity, target cleavage efficiency, target site selection, target sequence length, CRISPR effector protein size, ability of effector protein to access regions of high chromatin accessibility, degree of uniform enzyme activity across genomic targets, epigenetic tolerance, mismatch/budge tolerance, and wherein optimization of safety comprises optimizing one or more parameters or variables selected from CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector expression level, gRNA expression level, CRISPR-Cas complex expression level, CRISPR effector spatiotemporal expression, gRNA spatiotemporal expression, CRISPR-Cas complex spatiotemporal expression.

In an aspect, the invention relates to a method as described herein, comprising optimization of selected parameters or variables associated with the CRISPR-Cas system and/or its functionality, wherein specificity, efficacy, and/or safety are optimized, and optionally wherein optimization of specificity comprises optimizing one or more parameters or variables selected from CRISPR effector specificity, gRNA specificity, CRISPR-Cas complex specificity, PAM restrictiveness, PAM type (natural or modified), PAM nucleotide content, PAM length, wherein optimization of efficacy comprises optimizing one or more parameters or variables selected from CRISPR effector activity, gRNA activity, CRISPR-Cas complex activity, target cleavage efficiency, target site selection, target sequence length, CRISPR effector protein size, ability of effector protein to access regions of high chromatin accessibility, degree of uniform enzyme activity across genomic targets, epigenetic tolerance, mismatch/budge tolerance, and wherein optimization of safety comprises optimizing one or more parameters or variables selected from CRISPR effector stability, CRISPR effector mRNA stability, gRNA stability, CRISPR-Cas complex stability, CRISPR effector protein or mRNA immunogenicity or toxicity, gRNA immunogenicity or toxicity, CRISPR-Cas complex immunogenicity or toxicity, CRISPR effector protein or mRNA dose or titer, gRNA dose or titer, CRISPR-Cas complex dose or titer, CRISPR effector expression level, gRNA expression level, CRISPR-Cas complex expression level, CRISPR effector spatiotemporal expression, gRNA spatiotemporal expression, CRISPR-Cas complex spatiotemporal expression.

It will be understood that the parameters or variables to be optimized as well as the nature of optimization may depend on the (therapeutic) target, the CRISPR-Cas system functionality, the CRISPR-Cas system mode of delivery, and/or the CRISPR-Cas system delivery vehicle or expression system.

In an aspect, the invention relates to a method as described herein, comprising optimization of gRNA specificity at the population level. Preferably, said optimization of gRNA specificity comprises minimizing gRNA target site sequence variation across a population and/or minimizing gRNA off-target incidence across a population.

In an aspect, the invention relates to a method for developing or designing a CRISPR-Cas system, optionally a CRISPR-Cas system based therapy or therapeutic, comprising (a) selecting for a (therapeutic) locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub)selected target sites needed to treat or otherwise modulate or manipulate a population, optionally validating one or more of the (sub)selected target sites for an individual subject, optionally designing one or more gRNA recognizing one or more of said (sub)selected target sites.

In an aspect, the invention relates to a method for developing or designing a gRNA for use in a CRISPR-Cas system, optionally a CRISPR-Cas system based therapy or therapeutic, comprising (a) selecting for a (therapeutic) locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub)selected target sites needed to treat or otherwise modulate or manipulate a population, optionally validating one or more of the (sub)selected target sites for an individual subject, optionally designing one or more gRNA recognizing one or more of said (sub)selected target sites.

In an aspect, the invention relates to a method for developing or designing a CRISPR-Cas system, optionally a CRISPR-Cas system based therapy or therapeutic in a population, comprising (a) selecting for a (therapeutic) locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub)selected target sites needed to treat or otherwise modulate or manipulate a population, optionally validating one or more of the (sub)selected target sites for an individual subject, optionally designing one or more gRNA recognizing one or more of said (sub)selected target sites.

In an aspect, the invention relates to a method for developing or designing a gRNA for use in a CRISPR-Cas system, optionally a CRISPR-Cas system based therapy or therapeutic in a population, comprising (a) selecting for a locus of interest gRNA target sites, wherein said target sites have minimal sequence variation across a population, and from said selected target sites subselecting target sites, wherein a gRNA directed against said target sites recognizes a minimal number of off-target sites across said population, or (b) selecting for a (therapeutic) locus of interest gRNA target sites, wherein said target sites have minimal sequence variation across a population, or selecting for a (therapeutic) locus of interest gRNA target sites, wherein a gRNA directed against said target sites recognizes a minimal number of off-target sites across said population, and optionally estimating the number of (sub)selected target sites needed to treat or otherwise modulate or manipulate a population, optionally validating one or more of the (sub)selected target sites for an individual subject, optionally designing one or more gRNA recognizing one or more of said (sub)selected target sites.

In a further aspect, the invention relates to method for developing or designing a CRISPR-Cas system, such as a CRISPR-Cas system based therapy or therapeutic, optionally in a population; or for developing or designing a gRNA for use in a CRISPR-Cas system, optionally a CRISPR-Cas system based therapy or therapeutic, optionally in a population, comprising: selecting a set of target sequences for one or more loci in a target population, wherein the target sequences do not contain variants occurring above a threshold allele frequency in the target population (platinum target sequences); removing from said selected (platinum) target sequences any target sequences having high frequency off-target candidates (relative to other (platinum) targets in the set) to define a final target sequence set; preparing one or more, such as a set of CRISPR-Cas systems based on the final target sequence set, optionally wherein a number of CRISP-Cas systems prepared is based (at least in part) on the size of a target population.

In certain embodiments, off-target candidates/off-targets, PAM restrictiveness, target cleavage efficiency, or effector protein specificity is identified or determined using a sequencing-based double-strand break (DSB) detection assay, such as described herein elsewhere. In certain embodiments, off-target candidates/off-targets are identified or determined using a sequencing-based double-strand break (DSB) detection assay, such as described herein elsewhere. In certain embodiments, off-targets, or off target candidates have at least 1, preferably 1-3, mismatches or (distal) PAM mismatches, such as 1 or more, such as 1, 2, 3, or more (distal) PAM mismatches. In certain embodiments, sequencing-based DSB detection assay comprises labeling a site of a DSB with an adapter comprising a primer binding site, labeling a site of a DSB with a barcode or unique molecular identifier, or combination thereof, as described herein elsewhere.

It will be understood that the guide sequence of the gRNA is 100% complementary to the target site, i.e. does not comprise any mismatch with the target site. It will be further understood that "recognition" of an (off-)target site by a gRNA presupposes CRISPR-Cas system functionality, i.e. an (off-)target site is only recognized by a gRNA if binding of the gRNA to the (off-)target site leads to CRISPR-Cas system activity (such as induction of single or double strand DNA cleavage, transcriptional modulation, etc).

In certain embodiments, the target sites having minimal sequence variation across a population are characterized by absence of sequence variation in at least 99%, preferably at least 99.9%, more preferably at least 99.99% of the population. In certain embodiments, optimizing target location comprises selecting target sequences or loci having an absence of sequence variation in at least 99%, %, preferably at least 99.9%, more preferably at least 99.99% of a population. These targets are referred to herein elsewhere also as "platinum targets". In certain embodiments, said population comprises at least 1000 individuals, such as at least 5000 individuals, such as at least 10000 individuals, such as at least 50000 individuals.

In certain embodiments, the off-target sites are characterized by at least one mismatch between the off-target site and the gRNA. In certain embodiments, the off-target sites are characterized by at most five, preferably at most four, more preferably at most three mismatches between the off-target site and the gRNA. In certain embodiments, the off-target sites are characterized by at least one mismatch between the off-target site and the gRNA and by at most five, preferably at most four, more preferably at most three mismatches between the off-target site and the gRNA.

In certain embodiments, said minimal number of off-target sites across said population is determined for high-frequency haplotypes in said population. In certain embodiments, said minimal number of off-target sites across said population is determined for high-frequency haplotypes of the off-target site locus in said population. In certain embodiments, said minimal number of off-target sites across said population is determined for high-frequency haplotypes of the target site locus in said population. In certain embodiments, the high-frequency haplotypes are characterized by occurrence in at least 0.1% of the population.

In certain embodiments, the number of (sub)selected target sites needed to treat a population is estimated based on based low frequency sequence variation, such as low frequency sequence variation captured in large scale sequencing datasets. In certain embodiments, the number of (sub)selected target sites needed to treat a population of a given size is estimated.

In certain embodiments, the method further comprises obtaining genome sequencing data of a subject to be treated; and treating the subject with a CRISPR-Cas system selected from the set of CRISPR-Cas systems, wherein the CRISPR-Cas system selected is based (at least in part) on the genome sequencing data of the individual.

In certain embodiments, the ((sub)selected) target is validated by genome sequencing, preferably whole genome sequencing.

In certain embodiments, target sequences or loci as described herein are (further) selected based on optimization of one or more parameters consisting of, PAM type (natural or modified), PAM nucleotide content, PAM length, target sequence length, PAM restrictiveness, target cleavage efficiency, and target sequence position within a gene, a locus or other genomic region.

In certain embodiments, target sequences or loci as described herein are (further) selected based on optimization of one or more of target loci location, target length, target specificity, and PAM characteristics. As used herein, PAM characteristics may comprise for instance PAM sequence, PAM length, and/or PAM GC contents. In certain embodiments, optimizing PAM characteristics comprises optimizing nucleotide content of a PAM. In certain embodiments, optimizing nucleotide content of PAM is selecting a PAM with a motif that maximizes abundance in the one or more target loci, minimizes mutation frequency, or both. Minimizing mutation frequency can for instance be achieved by selecting PAM sequences devoid of or having low or minimal CpG.

In certain embodiments, the effector protein for each CRISPR-Cas system in the set of CRISPR-Cas systems is selected based on optimization of one or more parameters selected from the group consisting of; effector protein size, ability of effector protein to access regions of high chromatin accessibility, degree of uniform enzyme activity across genomic targets, epigenetic tolerance, mismatch/budge tolerance, effector protein specificity, effector protein stability or half-life, effector protein immunogenicity or toxicity.

In certain embodiments, optimizing target (sequence) length comprises selecting a target sequence within one or more target loci between 5 and 25 nucleotides. In certain embodiments, a target sequence is 20 nucleotides.

In certain embodiments, optimizing target specificity comprises selecting targets loci that minimize off-target candidates.

In certain embodiments, the gRNA is a tru gRNA, an escorted gRNA, or a protected gRNA.

It will be understood that the CRISPR-Cas systems according to the invention as described herein, such as the CRISPR-Cas systems for use in the methods according to the invention as described herein, may be suitably used for any type of application known for CRISPR-Cas systems, preferably in eukaryotes. In certain aspects, the application is therapeutic, preferably therapeutic in a eukaryote organism, such as including but not limited to animals (including human), plants, algae, fungi (including yeasts), etc. Alternatively, or in addition, in certain aspects, the application may involve accomplishing or inducing one or more particular traits or characteristics, such as genotypic and/or phenotypic traits or characteristics, as also described herein elsewhere.

For the invention described herein, the following criteria may be taken into account when optimizing the respective parameters or variables.

Selection of Cas Proteins

1. Size:

Currently, CRISPR single nuclease effectors demonstrating high efficiency mammalian genome editing range from 1053 amino acids (SaCas9) to 1368 amino acids (SpCas9), (AsCpf1, 1307aa; and LbCpf1, 1246). While smaller orthologs of Cas9 do exist and cleave DNA with high efficiency in vitro, Cas9 orthologs smaller than SaCas9 have shown diminished mammalian DNA cleavage efficiency. The large size of current single effector CRISPR nucleases is challenging for both nanoparticle protein delivery and viral vector delivery strategies. For protein delivery, payload per particle is a function of 3-D protein size, and for viral delivery of single effectors, large gene size limits flexibility for multiplexing or use of large cell-type specific promoters. Considerations relating to delivery are described detailed further herein below.

2. Protein Search:

The ability of the CRISPR effector to access regions of high chromatin complexity can be viewed in two ways 1) this increases the versatility of the CRISPR effector as a tool for genome editing or 2) this may be undesirable due to cellular dysregulation resulting from perturbation of the genomic structure of cells contacted with the CRISPR effector. There have been reports that the most active Cas9 guides are ones that target low nucleosomal occupancy positions: elifesciences.org/content/5/e12677, and elifesciences.org/content/5/e13450; however, over a longer time scale, cleavage can still occur (also cleavage can occur during replication when the nucleosomal occupancy is moved) Considerations relating to choice of Cas and modifications thereof are described detailed further herein below.

3. Efficacy:

Overall efficiency: robust and uniform enzyme activity across genomic targets in regions of open chromatin is generally desirable for all single effector nucleases. On the other hand, robust and uniform enzyme activity across genomic targets with varying chromatin complexity and epigenetic marks may not be desirable for research and therapeutic applications. It has been shown that Cas9 shows robust cleavage of methylated DNA, and this increases the utility of the enzyme. On the other hand, CRISPR effector binding or cleavage at loci enriched for epigenetic marks may dysregulate cellular processes. A further aspect to be considered is whether enzymes that do not disturb chromatin structure are desirable. If cleaving a locus in a terminally differentiated cell, it may be desirable to utilize enzymes that are not capable of penetrating silenced regions of the genome. Alternatively, when cleaving a locus in a precursor of a differentiated cell type, then it may be advantageous to be able to penetrate regions of the genome inactive at the time of editing.

4. Specificity: Mismatch/Bulge Tolerance:

Naturally occurring Cas9 orthologs: naturally occurring CRISPR effectors show tolerance of mismatches or bulges between the RNA guide and DNA target. This tolerance is generally undesirable for therapeutic applications. For therapeutic applications, patients should be individually screened for perfect target guide RNA complementarity, and tolerance of bulges and mismatches will only increase the likelihood of off-target DNA cleavage. High specificity engineered variants have been developed, such as eSpCas9 and Cas9-HF1 for Cas9; these variants show decreased tolerance of mismatches between DNA targets and the RNA guide (relevant to mismatches in approximately the PAM distal 12-14 nucleotides of the guide RNA given 20nt of guide RNA target complementarity).

5. PAM Choice:

Natural PAM vs. Modified PAM: Targets for each single effector CRISPR DNA endonuclease discovered so far require a protospacer adjacent motif (PAM) flanking the guide RNA complimentary region of the target. For the DNA endonucleases discovered so far, the PAM motifs have at least 2 nucleotides of specificity, such as 2, 3, 4, 5 or more nucleotides of specificity, such as 2-4 or 2-5 nucleotides of specificity, which curtails the fraction of possible targets in the genome that can be cleaved with a single natural enzyme. Mutation of naturally occurring DNA endonucleases has resulted in protein variants with modified PAM specificities. Cumulatively, the more such variants exist for a given protein targeting different PAMs, the greater the density of genomic targets are available for use in therapeutic design (See population efficacy). Nucleotide content: Nucleotide content of PAMs can affect what fraction of the genome can be targeted with an individual protein due to differences in the abundance of a particular motif in the genome or in a specific therapeutic locus of the genome. Additionally, nucleotide content can affect PAM mutation frequencies in the genome (See population efficacy). Cas proteins with altered PAM specificity can address this issue (as described further herein). Influence of PAM length/complexity on target specificity: Cas9 interrogates the genome by first binding to a PAM site before attempting to create a stable RNA/DNA duplex by melting the double stranded DNA. Since the complexity of the PAM limits the possible space of targets interrogated, a more complex PAM will have fewer possible sites at which off-target cleavage can occur.

6. crRNA Processing Capabilities of the Enzyme: Multiplexing:

For multiplexing, crRNA processing capabilities are desirable, as a transcript expressed from a single promoter can contain multiple different crRNAs. This transcript is then processed into multiple constituent crRNAs by the protein, and multiplexed editing proceeds for each target specified by the crRNA. On the other hand, the rules for RNA endonucleolytic processing of multi crRNA transcripts into crRNAs are not fully understood. Hence, for therapeutic applications, crRNA processing may be undesirable due to off-target cleavage of endogenous RNA transcripts.

Target Choice

1. Target Length:

Although most protospacer elements observed in naturally occurring Cas CRISPR arrays are longer than 20nt, protospacer complimentary regions of resulting crRNA products are often processed to 20nt (Cas9) or do not confer specificity beyond 20nt (Cpf1). Extension of the target complimentary region of the guide RNA beyond 20nt likely is positioned outside of the footprint of the protein on the guide RNA and is often processed away by exonucleases (See protected guide RNAs for further discussion).

2. Efficiency Screening:

Screening for CRISPR effector efficacy has been performed by studying the efficacy of knockdown of cell surface proteins using different DNA targets. These studies show some evidence that position dependent nucleotide content in CRISPR effector targets and flanking nucleotides affects the efficacy of target cleavage.

3. Specificity Screening:

Unbiased investigation of genome-wide CRISPR nuclease activity suggests that most off-target activity occurs at loci with at most three mismatches to the RNA guide. Current approaches for CRISPR effector target selection rank off-target candidates found in the reference human genome by both the number and position of RNA guide mismatches, with the assumption that loci containing less than 3 mismatches or containing PAM distal mismatches are more likely to be cleaved. However, in a population of individuals, this strategy is complicated by the existence of multiple haplotypes (sets of associated variants), which will contain different positions or numbers of mismatches at candidate off-target sites (See: population safety).

Guide RNA Design

Several technologies have been developed to address different aspects of efficacy and specificity 1. Tru Guide:

Trimming 1-3 nt off from the 3' end of the target complimentary region of the gRNA often decreases activity at off-target loci containing at least one mismatch to the guide RNA. Likely, with fewer nucleotides of base-pairing between the off-target and gRNA, each mismatch has a greater thermodynamic consequence to the stability of the CRISPR effector-gRNA complex with the off-target DNA. Percentage of successfully cleaved targets may be reduced in using tru guides: i.e., some sites that worked with a 20nt guide may not cut efficiently with a 17nt guide; but the ones that do work with 17nt generally cleavage as efficiently.

2. Protected Guide:

Protected guides utilize an extended guide RNA and/or trans RNA/DNA elements to 1) create stable structures in the sgRNA that compete with sgRNA base-pairing at a target or off-target site or 2) (optionally) extend complimentary nucleotides between the gRNA and target. For extended RNA implementations, secondary structure results from complementarity between the 3' extension of the guide RNA and another target complimentary region of the guide RNA. For trans implementations, DNA or RNA elements bind the extended or normal length guide RNA partially obscuring the target complimentary region of the sgRNA.

Dosage

The dosage of the CRISPR components should take into account the following factors 1. Target Search:

CRISPR effector/guide RNA-enzyme complexes use 3-D stochastic search to locate targets. Given equal genomic accessibility, the probability of the complex finding an off-target or on-target is similar.

2. Binding (Target Dwell Time):

Once located, the binding kinetics of the complex at an on-target or an off-target with few mismatches differs only slightly. Hence, target search and binding are likely not the rate-limiting steps for DNA cleavage at on-target or off-target loci. ChIP data suggests that complex dwell time does decrease accompanying increasing mismatches between the off-target locus and RNA guide, particularly in the PAM-proximal 'seed' region of the RNA guide.

3. Cutting (Thermodynamic Barrier to Assuming an Active Conformation):

A major rate-limiting step for CRISPR effector enzymatic activity appears to be configuration of the target DNA and guide RNA-protein complex in an active conformation for DNA cleavage. Increasing mismatches at off-target loci decrease the likelihood of the complex achieving an active conformation at off-target loci.

The difference between binding and cutting is why ChIP has very low predictive power as a tool for evaluating the off-target cleavage of Cas.

If the probability of finding an off-target or on-target is similar, then the difference in rate of on and off-target cleavage is likely due to the fact that the probability of cleavage at on target sites is greater than off target sites. (See temporal control) The stochastic search means that Cas suggests that an incorrect model is to view Cas as preferentially cleaving the on-target site first and only moving onto off-target sites after on-target cleavage is saturated; instead, all sites are interrogated at random, and the probability of progression to cutting after PAM binding is what differentiates the propensity of on vs. off-target cutting.

4. Repetition in DNA Modification at an Individual Locus:

NHEJ repair of DNA double strand breaks is generally high fidelity (Should find exact error rate). Hence, it is likely that a nuclease must cut an individual locus many times before an error in NHEJ results in an indel at the cut site. The probability of observing an indel is the compounding probability of observing a double strand break based on 1) target search probability, 2) target dwell time, and 3) overcoming the thermodynamic barrier to DNA cleavage.

5. Enzyme Concentration:

Even at very low concentrations, search may still encounter an off-target prior to an on-target. Thereafter, the number and location of mismatches in an off-target, and likely the nucleotide content of the target will influence the likelihood of DNA cleavage.

Thinking about on/off target cleavage in probabilistic terms, each interaction that Cas has with the genome can be thought of as having some probability of successful cleavage. Reducing the dose will reduce the number of effector molecules available for interacting with the genome, and thus will limit the additive probability of repeated interactions at off-target sites.

Temporal and Spatial Control of the CRISPR System

Various technologies have been developed which provide additional options for addressing efficacy, specificity and safety issues. More particularly these options can be used to allow for temporal control. More particularly these technologies allow for temporal/spatial control (as described further herein):

1. Double Nickases
2. Escorted Guides
3. Split-Effector Protein
4. "Self-Inactivating" Systems or "Governing Guides"

In the following, the different variables and how they influence the design of a CRISPR-based editing system are described in more detail.

Specificity—Select Most Specific Guide RNA a. Guide Specificity

While early reports were fairly contradictory on the ability to accurately predict guide RNAs with limited off-target activity, statistical analysis based on a large number of data has made it possible to identify rules governing off-target effects. Doench et al. (Nat Biotechnol. 2016 February; 34(2):184-91) describe the profiling of the off-target activity of thousands of sgRNAs and the development of a metric to predict off-target sites.

Accordingly, in particular embodiments, the methods of the invention involve selecting a guide RNA which, based on statistical analysis, is less likely to generate off-target effects.

b. Guide Complementarity

It is generally envisaged that the degree of complementarity between a guide sequence and its corresponding target sequence should be as high as possible, such as more than about 50%, 60%, 75%, 80%, 85%, 90%, 95%, 97.5%, 99%, or 100%; However, in particular embodiments, a particular concern is reducing off-target interactions, e.g., reducing the guide interacting with a target sequence having low complementarity. It has been shown that certain mutations result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in particular embodiments, the guide is selected such that the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

c. Select Guide/Enzyme Concentration

For minimization of toxicity and off-target effect, it will be important to control the concentration of Cas protein and guide RNA delivered. Optimal concentrations of Cas protein and guide RNA can be determined by testing different concentrations in a cellular or non-human eukaryote animal model and using deep sequencing the analyze the extent of modification at potential off-target genomic loci. For example, for the guide sequence targeting 5'-GAGTCCGAGCAGAAGAAGAA-3' (SEQ ID NO: 194) in the EMX1 gene of the human genome, deep sequencing can be used to assess the level of modification at the following two off-target loci, 1: 5'-GAGTCCTAGCAG-GAGAAGAA-3' (SEQ ID NO: 195) and 2: 5'-GAGTCTAAGCAGAAGAAGAA-3' (SEQ ID NO: 196). The concentration that gives the highest level of on-target modification while minimizing the level of off-target modification should be chosen for in vivo delivery.

Selection Based on Specificity a. Enzyme Modifications to Enhance Specificity

In particular embodiments, a reduction of off-target cleavage is ensured by destabilizing strand separation, more particularly by introducing mutations in the Cas enzyme decreasing the positive charge in the DNA interacting regions (as described herein and further exemplified for Cas9 by Slaymaker et al. 2016 (Science, 1;351(6268):84-8). In further embodiments, a reduction of off-target cleavage is ensured by introducing mutations into Cas enzyme which affect the interaction between the target strand and the guide RNA sequence, more particularly disrupting interactions between Cas and the phosphate backbone of the target DNA strand in such a way as to retain target specific activity but reduce off-target activity (as described for Cas9 by Kleinstiver et al. 2016, Nature, 28;529(7587):490-5). In particular embodiments, the off-target activity is reduced by way of a modified Cas wherein both interaction with target strand and non-target strand are modified compared to wild-type Cas.

The methods and mutations which can be employed in various combinations to increase or decrease activity and/or specificity of on-target vs. off-target activity, or increase or decrease binding and/or specificity of on-target vs. off-target binding, can be used to compensate or enhance mutations or modifications made to promote other effects. Such mutations or modifications made to promote other effects include mutations or modification to the Cas effector protein and or mutation or modification made to a guide RNA.

With a similar strategy used to improve Cas9 specificity (Slaymaker et al. 2015 "Rationally engineered Cas9 nucleases with improved specificity"), specificity of Cas can be improved by mutating residues that stabilize the non-targeted DNA strand. This may be accomplished without a crystal structure by using linear structure alignments to predict 1) which domain of Cas binds to which strand of DNA and 2) which residues within these domains contact DNA.

However, this approach may be limited due to poor conservation of Cas with known proteins. Thus it may be desirable to probe the function of all likely DNA interacting amino acids (lysine, histidine and arginine).

Positively charged residues in the RuvC domain are more conserved throughout Cas proteins than those in the Rad50 domain indicating that RuvC residues are less evolutionarily flexible. This suggests that rigid control of nucleic acid binding is needed in this domain (relative to the Rad50 domain). Therefore, it is possible this domain cuts the targeted DNA strand because of the requirement for RNA:DNA duplex stabilization (precedent in Cas9). Furthermore, more arginines are present in the RuvC domain (5% of RuvC residues 904 to 1307 vs 3.8% in the proposed Rad50 domains) suggesting again that RuvC targets one of the DNA strands. Arginines are more involved in binding nucleic acid major and minor grooves (Rohs Nature 2009: rohslab.cmb.usc.edu/Papers/Rohs_etal_Nature.pdf). Major/minor grooves would only be present in a duplex (such as DNA:RNA targeting duplex), further suggesting that RuvC may be involved in cutting.

Based on the structural analysis of the RuvC and Rad50 domains, it can be deduced what the relevant domains look like in Cas, and infer which regions and residues may contact DNA. Accordingly, in certain embodiments the Cpf1 enzyme is modified by mutation of one or more residues (in the RuvC domain) including but not limited positions R909, R912, R930, R947, K949, R951, R955, K965, K968, K1000, K1002, R1003, K1009, K1017, K1022, K1029, K1035, K1054, K1072, K1086, R1094, K1095, K1109, K1118, K1142, K1150, K1158, K1159, R1220, R1226, R1242, and/or R1252 with reference to amino acid position numbering of AsCpf1 (*Acidaminococcus* sp. BV3L6). Additionally or alternatively, in certain embodiments, the Cpf1 enzyme is modified by mutation of one or more residues (in the RAD50) domain including but not limited positions K324, K335, K337, R331, K369, K370, R386, R392, R393, K400, K404, K406, K408, K414, K429, K436, K438, K459, K460, K464, R670, K675, R681, K686, K689, R699, K705, R725, K729, K739, K748, and/or K752 with reference to amino acid position numbering of AsCpf1 (*Acidaminococcus* sp. BV3L6).

From these specific observations about AsCpf1 similar residues can be identified in Cas from other species by sequence alignments. In certain embodiments, the Cpf1 enzyme is modified by mutation of one or more residues including but not limited positions R912, T923, R947, K949, R951, R955, K965, K968, K1000, R1003, K1009, K1017, K1022, K1029, K1072, K1086, F1103, R1226, and/or R1252 with reference to amino acid position numbering of AsCpf1 (*Acidaminococcus* sp. BV3L6). In certain embodiments, the enzyme is modified by mutation of one or more residues including but not limited positions R833, R836, K847, K879, K881, R883, R887, K897, K900, K932, R935, K940, K948, K953, K960, K984, K1003, K1017, R1033, R1138, R1165, and/or R1252 with reference to amino acid position numbering of LbCpf1 (*Lachnospiraceae* bacterium ND2006).

b. Selecting Suitable PAM Recognition

The requirement of a protospacer adjacent motif (PAM) of most CRISPR effector proteins, ensures another level of specificity in that only the target which is preceded by the relevant motif for the enzyme, will be cleaved. Thus, in particular embodiments, where available it may be of interest to select an effector protein with a stringent PAM so as to reduce off-target effects. Such an effector protein may be a Cas ortholog or an effector protein having altered specificity.

On the other hand, the use of a Cas effector protein can be limited by its protospacer adjacent motif (PAM), in that it will only be able to robustly cleave target sites preceded by said motif. For instance, the *Acidaminococcus* sp. BV3L6 Cpf1 (AsCpf1), which has been successfully harnessed for genome editing can only cleave target sites precede by a TTTV protospacer adjacent motif (PAM), which limits its practical utility. Where broad applicability is desirable or required for multiplexing, the selection of an effector protein with a different PAM specificity may be of interest. Again, this altered specificity may be found in a Cas ortholog; However, it has been found that the Cas effector protein can be mutated to modify its PAM specificity.

Modification of PAM specificity has been performed by a structure-guided saturation mutagenesis screen to increase the targeting range of Cas (Linyi Gao et al. 2016, BioRxiv, dx.doi.org/10.1101/091611). Two variants of AsCpf1 were engineered with the mutations S542R/K607R and S542R/K548V/N552R that can cleave target sites with TYCV/CCCC and TATV PAMs, respectively, with enhanced activities in vitro and in human cells. Genome-wide assessment of off-target activity indicated that these variants retain a high level of DNA targeting specificity. It was found that by the provision of the additional AsCpf1 effector protein variants, this results in the addition of one cleavage site for every ~8.7 bp in non-repetitive regions of the human genome.

Further Cas mutants are also envisaged herein. In particular embodiments, a mutated Cas is used wherein the mutated Cas comprises one or more mutated amino acid residue at position 11, 12, 13, 14, 15, 16, 17, 34, 36, 39, 40, 43, 46, 47, 50, 54, 57, 58, 111, 126, 127, 128, 129, 130, 131, 132, 133, 134, 135, 136, 157, 158, 159, 160, 161, 162, 163, 164, 165, 166, 167, 168, 169, 170, 171, 172, 173, 174, 175, 176, 177, 178, 532, 533, 534, 535, 536, 537, 538, 539, 540, 541, 542, 543, 544, 545, 546, 547, 548, 549, 550, 551, 552, 553, 554, 555, 556, 565, 566, 567, 568, 569, 570, 571, 572, 573, 574, 575, 592, 593, 594, 595, 596, 597, 598, 599, 600, 601, 602, 603, 604, 605, 606, 607, 608, 609, 610, 611, 612, 613, 614, 615, 616, 617, 618, 619, 620, 626, 627, 628, 629, 630, 631, 632, 633, 634, 635, 636, 637, 638, 642, 643, 644, 645, 646, 647, 648, 649, 651, 652, 653, 654, 655, 656, 676, 679, 680, 682, 683, 684, 685, 686, 687, 688, 689, 690, 691, 692, 693, 707, 711, 714, 715, 716, 717, 718, 719, 720, 721, 722, 739, 765, 768, 769, 773, 777, 778, 779, 780, 781, 782, 783, 784, 785, 786, 871, 872, 873, 874, 875, 876, 877, 878, 879, 880, 881, 882, 883, 884, or 1048; preferably, one or more mutated amino acid residue at position 130, 131, 132, 133, 134, 135, 136, 162, 163, 164, 165, 166, 167, 168, 169, 170, 171, 172, 173, 174, 175, 176, 177, 536, 537, 538, 539, 540, 541, 542, 543, 544, 545, 546, 547, 548, 549, 550, 551, 552, 570, 571, 572, 573, 595, 596, 597, 598, 599, 600, 601, 602, 603, 604, 605, 606, 607, 608, 609, 610, 611, 612, 613, 614, 615, 630, 631, 632, 646, 647, 648, 649, 650, 651, 652, 653, 683, 684, 685, 686, 687, 688, 689, or 690; more preferably one or more mutated amino acid residue at position 539, 542, 547, 548, 550, 551, 552, 167, 604, and/or 607 of AsCpf1, or the corresponding position of an AsCpf1 orthologue, homologue, or variant, preferably mutated amino acid residues at positions 542 or 542 and 607, wherein said mutations preferably are 542R and 607R, such as S542R and K607R; or preferably mutated amino acid residues at positions 542 and 548 (and optionally 552), wherein said mutations preferably are 542R and 548V (and optionally 552R), such as S542R and K548V (and optionally N552R); or at position 532, 538, 542, and/or 595 of LbCpf1, or the corresponding position of an AsCpf1 orthologue, homologue, or variant, preferably mutated amino acid residues at positions 532 or 532 and 595, wherein said mutations preferably are 532R and 595R, such as G532R and K595R; or preferably mutated amino acid residues at positions 532 and 538 (and optionally 542), wherein said mutations preferably are 532R and 538V (and optionally 542R), such as G532R and K538V (and optionally Y542R).

Accordingly, these variants increase the targeting range, providing a useful addition to the CRISPR/Cas genome engineering toolbox. At the same time, the provision of Cas effector proteins with alternative PAM specificity allows for the selection of a particular variant with optimal specificity for a particular target sequence.

System Approaches to Reduce Off-Target Effects:

a. Double Nickase

Alternatively, to minimize the level of toxicity and off-target effect, a Cas nickase can be used with a pair of guide RNAs targeting a site of interest. Guide sequences and strategies to minimize toxicity and off-target effects can be as in WO 2014/093622 (PCT/US2013/074667); or, via mutation as described herein.

The invention thus contemplates methods of using two or more nickases, in particular a dual or double nickase approach. In some aspects and embodiments, a single type FnCpf1, AsCpf1 or LbCpf1 nickase may be delivered, for example a modified FnCpf1, AsCpf1 or LbCpf1 or a modified FnCpf1, AsCpf1 or LbCpf1 nickase as described herein. This results in the target DNA being bound by two FnCpf1 nickases. In addition, it is also envisaged that different orthologs may be used, e.g., an FnCpf1, AsCpf1 or LbCpf1 nickase on one strand (e.g., the coding strand) of the DNA and an ortholog on the non-coding or opposite DNA strand. The ortholog can be, but is not limited to, a Cas nickase such as a AsCpf1 nickase or a LbCpf1 nickase or FnCpf1 nickase. It may be advantageous to use two different orthologs that require different PAMs and may also have different guide requirements, thus allowing a greater deal of control for the user. In certain embodiments, DNA cleavage will involve at least four types of nickases, wherein each type is guided to a different sequence of target DNA, wherein each pair introduces a first nick into one DNA strand and the second introduces a nick into the second DNA strand. In such methods, at least two pairs of single stranded breaks are introduced into the target DNA wherein upon introduction of first and second pairs of single-strand breaks, target sequences between the first and second pairs of single-strand breaks are excised. In certain embodiments, one or both of the orthologs is controllable, i.e. inducible.

b. Escorted Guides

The methods provided herein may also involve the use of escorted Cas CRISPR-Cas systems or complexes, especially such a system involving an escorted Cas CRISPR-Cas system guide. By "escorted" is meant that the CRISPR-Cas system or complex or guide is delivered to a selected time or place within a cell, so that activity of the CRISPR-Cas system or complex or guide is spatially or temporally controlled. For example, the activity and destination of the CRISPR-Cas system or complex or guide may be controlled by an escort RNA aptamer sequence that has binding affinity for an aptamer ligand, such as a cell surface protein or other localized cellular component. Alternatively, the escort aptamer may for example be responsive to an aptamer effector on or in the cell, such as a transient effector, such as an external energy source that is applied to the cell at a particular time. The principle of escorted guides and embodiments thereof are described in detail in WO2016094874 incorporated by reference herein.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7 (2010): 537-550). These characteristics also suggest a wide range of uses for aptamers as drug delivery vehicles (Levy-Nissenbaum, Etgar, et al. "Nanotechnology and aptamers: applications in drug delivery." Trends in biotechnology 26.8 (2008): 442-449; and, Hicke B J, Stephens A W. "Escort aptamers: a delivery service for diagnosis and therapy." J Clin Invest 2000, 106:923-928.). Aptamers may also be constructed that function as molecular switches, responding to a que by changing properties, such as RNA aptamers that bind fluorophores to mimic the activity of green fluorescent protein (Paige, Jeremy S., Karen Y. Wu, and Samie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4). The aptamers used in this aspect are designed to improve gRNA delivery, including delivery across the cellular membrane, to intracellular compartments, or into the nucleus. Such a structure can include, either in addition to the one or more aptamer(s) or without such one or more aptamer(s), moiety(ies) so as to render the guide deliverable, inducible or responsive to a selected effector. In particular embodiments, a gRNA is designed that responds to normal or pathological physiological conditions, including without limitation pH, hypoxia, O2 concentration, temperature, protein concentration, enzymatic concentration, lipid structure, light exposure, mechanical disruption (e.g. ultrasound waves), magnetic fields, electric fields, or electromagnetic radiation. Accordingly, in particular embodiments, the escort aptamer has binding affinity for an aptamer ligand on or in the cell, or the escort aptamer is responsive to a localized aptamer effector on or in the cell, wherein the presence of the aptamer ligand or effector on or in the cell is spatially or temporally restricted.

Once intended alterations have been introduced, such as by editing intended copies of a gene in the genome of a cell, continued CRISPR/Cas expression in that cell is no longer necessary. Indeed, sustained expression would be undesirable in certain cases in case of off-target effects at unintended genomic sites, etc. Thus time-limited expression is of interest.

Inducible expression offers one approach, but in addition Applicants have engineered a Self-Inactivating CRISPR-Cas system that relies on the use of a non-coding guide target sequence within the CRISPR vector itself. Thus, after expression begins, the CRISPR system will lead to its own destruction, but before destruction is complete it will have time to edit the genomic copies of the target gene (which, with a normal point mutation in a diploid cell, requires at most two edits). Simply, the self-inactivating CRISPR-Cas system includes additional RNA (i.e., guide RNA) that targets the coding sequence for the CRISPR enzyme itself or that targets one or more non-coding guide target sequences complementary to unique sequences present in one or more of the following: (a) within the promoter driving expression of the non-coding RNA elements, (b) within the promoter driving expression of the Cas gene, (c) within 100 bp of the ATG translational start codon in the Cas coding sequence, (d) within the inverted terminal repeat (iTR) of a viral delivery vector, e.g., in an AAV genome.

Examples of inducible systems are light responsive systems. Light responsiveness of an inducible system is achieved via the activation and binding of cryptochrome-2 and CIB1. Blue light stimulation induces an activating conformational change in cryptochrome-2, resulting in recruitment of its binding partner CIB1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Crytochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

In particular embodiments, energy sources such as electromagnetic radiation, sound energy or thermal energy can induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 mW/cm2. In a preferred embodiment, a stimulation paradigm of as low as 0.25 sec every 15 sec should result in maximal activation.

In particular embodiments, the system is chemically inducible. Exemplary designs of chemical inducible systems include: 1. ABI-PYL based system inducible by Abscisic Acid (ABA) (see, e.g., stke.sciencemag.org/cgi/content/abstract/sigtrans;4/164/rs2), 2. FKBP-FRB based system inducible by rapamycin (or related chemicals based on rapamycin) (see, e.g., www.nature.com/nmeth/journal/v2/n6/full/nmeth763.html), 3. GID1-GAI based system inducible by Gibberellin (GA) (see, e.g., www.nature.com/nchembio/journal/v8/n5/full/nchembio.922.html). Another chemical inducible system is an estrogen receptor (ER) based system inducible by 4-hydroxytamoxifen (4OHT) (see, e.g., www.pnas.org/content/104/3/1027.abstract). A mutated ligand-binding domain of the estrogen receptor called ERT2 translocates into the nucleus of cells upon binding of 4-hydroxytamoxifen. In further embodiments of the invention any naturally occurring or engineered derivative of any nuclear receptor, thyroid hormone receptor, retinoic acid receptor, estrogen receptor, estrogen-related receptor, glucocorticoid receptor, progesterone receptor, androgen receptor may be used in inducible systems analogous to the ER based inducible system.

In particular embodiments, the chemical inducible system is based on change in sub-cellular localization. The polypeptide can include a DNA binding domain comprising at least five or more Transcription activator-like effector (TALE) monomers and at least one or more half-monomers specifically ordered to target the genomic locus of interest linked to at least one or more effector domains are further linker to a chemical or energy sensitive protein. This protein will lead to a change in the sub-cellular localization of the entire polypeptide (i.e. transportation of the entire polypeptide from cytoplasm into the nucleus of the cells) upon the binding of a chemical or energy transfer to the chemical or energy sensitive protein. This transportation of the entire polypeptide from one sub-cellular compartments or organelles, in which its activity is sequestered due to lack of substrate for the effector domain, into another one in which the substrate is present would allow the entire polypeptide to come in contact with its desired substrate (i.e. genomic DNA in the mammalian nucleus) and result in activation or repression of target gene expression.

Another inducible system is based on the design using Transient receptor potential (TRP) ion channel based system inducible by energy, heat or radio-wave (see, e.g., www-.sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the CRISPR-Cas complex or system, and the binding will induce the change of sub-cellular localization of the polypeptide, leading to the entire polypeptide entering the nucleus of cells. Once inside the nucleus, the guide protein and the other components of the CRISPR-Cas complex will be active and modulating target gene expression in cells. This type of system could also be used to induce the cleavage of a genomic locus of interest in a cell; and, in this regard, it is noted that the Cas enzyme is a nuclease. The light could be generated with a laser or other forms of energy sources. The heat could be generated by raise of temperature results from an energy source, or from nano-particles that release heat after absorbing energy from an energy source delivered in the form of radio-wave.

Photoinducibility provides the potential for spatial precision. Taking advantage of the development of optrode technology, a stimulating fiber optic lead may be placed in a precise brain region. Stimulation region size may then be tuned by light intensity. This may be done in conjunction with the delivery of the CRISPR-Cas system or complex of the invention, or, in the case of transgenic Cas animals, guide RNA of the invention may be delivered and the optrode technology can allow for the modulation of gene expression in precise brain regions. A culture medium for culturing host cells includes a medium commonly used for tissue culture, such as M199-earle base, Eagle MEM (E-MEM), Dulbecco MEM (DMEM), SC-UCM102, UP-SFM (GIBCO BRL), EX-CELL302 (Nichirei), EX-CELL293-S(Nichirei), TFBM-01 (Nichirei), ASF104, among others. Suitable culture media for specific cell types may be found at the American Type Culture Collection (ATCC) or the European Collection of Cell Cultures (ECACC). Culture media may be supplemented with amino acids such as L-glutamine, salts, anti-fungal or anti-bacterial agents such as Fungizone®, penicillin-streptomycin, animal serum, and the like. The cell culture medium may optionally be serum-free.

Temporal precision can also be achieved in vivo. This may be used to alter gene expression during a particular stage of development. This may be used to time a genetic cue to a particular experimental window. For example, genes implicated in learning may be overexpressed or repressed only during the learning stimulus in a precise region of the intact rodent or primate brain. Further, the invention may be used to induce gene expression changes only during particular stages of disease development. For example, an oncogene may be overexpressed only once a tumor reaches a particular size or metastatic stage. Conversely, proteins suspected in the development of Alzheimer's may be knocked down only at defined time points in the animal's life and within a particular brain region. Although these examples do not exhaustively list the potential applications of the invention, they highlight some of the areas in which the invention may be a powerful technology.

c. Protected Guide RNAs

In one aspect, it is of interest to further enhance the specificity of Cas given individual guide RNAs through thermodynamic tuning of the binding specificity of the guide RNA to target DNA. This is a general approach of introducing mismatches, elongation or truncation of the guide sequence to increase/decrease the number of complimentary bases vs. mismatched bases shared between a genomic target and its potential off-target loci, in order to give thermodynamic advantage to targeted genomic loci over genomic off-targets. Thus it can be of interest to modify the guide sequence by secondary structure to increase the specificity of the CRISPR-Cas system whereby the secondary structure can protect against exonuclease activity. This can be ensured by hybridizing a "protector RNA" to a guide sequence, wherein the "protector RNA" is an RNA strand complementary to the 5' end of the guide RNA (gRNA), to thereby generate a partially double-stranded gRNA. Protecting the mismatched bases with a perfectly complementary protector sequence decreases the likelihood of target DNA binding to the mismatched basepairs at the 3' end. In particular embodiments, additional sequences comprising an extended length may also be present. The principle of using protected guide RNAs is described in detail in WO/2016/094867, which is incorporated herein by reference.

Guide RNA (gRNA) extensions matching the genomic target provide gRNA protection and enhance specificity. Extension of the gRNA with matching sequence distal to the end of the spacer seed for individual genomic targets thus provides enhanced specificity. In particular embodiments, stable forms arise from protective states, where the extension forms a closed loop with the gRNA seed due to complimentary sequences in the spacer extension and the spacer seed. Thus, the protected guide concept also includes sequences matching the genomic target sequence distal of the 20mer spacer-binding region. Thermodynamic prediction can be used to predict completely matching or partially matching guide extensions that result in protected gRNA states as described in WO/2016/094867.

An extension sequence which corresponds to the extended length (ExL) may optionally be attached directly to the guide sequence at the 3' end of the protected guide sequence. The extension sequence may be 2 to 12 nucleotides in length. Preferably ExL may be denoted as 0, 2, 4, 6, 8, 10 or 12 nucleotides in length. In a preferred embodiment the ExL is denoted as 0 or 4 nucleotides in length. In a more preferred embodiment the ExL is 4 nucleotides in length. The extension sequence may or may not be complementary to the target sequence. An extension sequence may further optionally be attached directly to the guide sequence at the 5' end of the protected guide sequence as well as to the 3' end of a protecting sequence. As a result, the extension sequence serves as a linking sequence between the protected sequence and the protecting sequence. Without wishing to be bound by theory, such a link may position the protecting sequence near the protected sequence for improved binding of the protecting sequence to the protected sequence.

d. Formation of a RISC Through Guide Engineering

In some embodiments, the guide may be a protected guide (e.g. a pgRNA) or an escorted guide (e.g. an esgRNA) as described herein. Both of these, in some embodiments, make use of RISC. A RISC is a key component of RNAi. RISC (RNA-induced silencing complex) is a multiprotein, specifically a ribonucleoprotein, complex which incorporates one strand of a double-stranded RNA (dsRNA) fragment, such as small interfering RNA (siRNA) or microRNA (miRNA), which acts as a template for RISC to recognize a complementary messenger RNA (mRNA) transcript. The mRNA is thus cleaved by one of the components of the RISC.

As such, the formation of a RISC is advantageous in some embodiments. Guide RNAs according to various aspects of the present invention, including but not limited to protected and/or escorted guide RNAs, may be adapted to include RNA nucleotides that promote formation of a RISC, for example in combination with an siRNA or miRNA that may be provided or may, for instance, already be expressed in a cell. This may be useful, for instance, as a self-inactivating system to clear or degrade the guide.

Thus, the guide RNA may comprise a sequence complementary to a target miRNA or an siRNA, which may or may not be present within a cell. In this way, only when the miRNA or siRNA is present, for example through expression (by the cell or through human intervention), is there binding of the RNA sequence to the miRNA or siRNA which then results in cleavage of the guide RNA an RNA-induced silencing complex (RISC) within the cell. Therefore, in some embodiments, the guide RNA comprises an RNA sequence complementary to a target miRNA or siRNA, and binding of the guide RNA sequence to the target miRNA or siRNA results in cleavage of the guide RNA by an RNA-induced silencing complex (RISC) within the cell.

RISC formation through use of escorted guides is described in WO2016094874, RISC formation through use of protected guides is described in WO/2016/094867.

e. Use of Inducible Systems

In some embodiments, a CRISPR enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736, 465 and U.S. 61/721,283, and WO 2014/018423 A2 which is hereby incorporated by reference in its entirety.

f. Use of Inducible/Split Effector Enzymes

In an aspect the invention provides a (non-naturally occurring or engineered) inducible CRISPR protein according to the invention as described herein (CRISPR-Cas system), comprising:

a first CRISPR protein fusion construct attached to a first half of an inducible dimer and a second CRISPR protein fusion construct attached to a second half of the inducible dimer, wherein the first Cas fusion construct is operably linked to one or more nuclear localization signals, wherein the second CRISPR protein fusion construct is operably linked to one or more nuclear export signals, wherein contact with an inducer energy source brings the first and second halves of the inducible dimer together, wherein bringing the first and second halves of the inducible dimer together allows the first and second CRISPR protein fusion constructs to constitute a functional CRISPR protein (optionally wherein the CRISPR-Cas system comprises a guide RNA (gRNA) comprising a guide sequence capable of hybridizing to a target sequence in a genomic locus of interest in a cell, and wherein the functional CRISPR-Cas system binds to the target sequence and, optionally, edits the genomic locus to alter gene expression).

In an aspect of the invention in the inducible CRISPR-Cas system, the inducible dimer is or comprises or consists essentially of or consists of an inducible heterodimer. In an aspect, in inducible CRISPR-Cas system, the first half or a first portion or a first fragment of the inducible heterodimer is or comprises or consists of or consists essentially of an FKBP, optionally FKBP12. In an aspect of the invention, in the inducible CRISPR-Cas system, the second half or a second portion or a second fragment of the inducible heterodimer is or comprises or consists of or consists essentially of FRB. In an aspect of the invention, in the inducible CRISPR-Cas system, the arrangement of the first CRISPR fusion construct is or comprises or consists of or consists essentially of N' terminal CRISPR part-FRB-NES. In an aspect of the invention, in the inducible CRISPR-Cas system, the arrangement of the first CRISP fusion construct is or comprises or consists of or consists essentially of NES-N' terminal CRISP part-FRB-NES. In an aspect of the invention, in the inducible CRISPR-Cas system, the arrangement of the second CRISP fusion construct is or comprises or consists essentially of or consists of C' terminal CRISP part-FKBP-NLS. In an aspect the invention provides in the inducible Cas CRISPR-Cas system, the arrangement of the second CRISP fusion construct is or comprises or consists of or consists essentially of NLS-C' terminal CRISP part-FKBP-NLS. In an aspect, in inducible CRISPR-Cas system there can be a linker that separates the CRISP part from the half or portion or fragment of the inducible dimer. In an aspect, in the inducible CRISPR-Cas system, the inducer energy source is or comprises or consists essentially of or consists of rapamycin. In an aspect, in inducible CRISPR-Cas system, the inducible dimer is an inducible homodimer. In an aspect, in an inducible Cpf1 CRISPR-Cas system, the Cpf1 is AsCpf1, LbCpf1 or FnCpf1.

In an aspect, the invention provides a (non-naturally occurring or engineered) inducible CRISPR-Cas system, comprising: a first CRISPR fusion construct attached to a first half of an inducible heterodimer and a second CRISPR fusion construct attached to a second half of the inducible heterodimer, wherein the first CRISPR fusion construct is operably linked to one or more nuclear localization signals, wherein the second CRISPR fusion construct is operably linked to a nuclear export signal, wherein contact with an inducer energy source brings the first and second halves of the inducible heterodimer together, wherein bringing the first and second halves of the inducible heterodimer together allows the first and second CRISPR fusion constructs to constitute a functional CRISPR (optionally wherein the CRISPR-Cas system comprises a guide RNA (gRNA) comprising a guide sequence capable of hybridizing to a target sequence in a genomic locus of interest in a cell, and wherein the functional CRISPR-Cas system edits the genomic locus to alter gene expression).

Accordingly, the invention comprehends inter alia homodimers as well as heterodimers, dead-CRISPR or CRISPR protein having essentially no nuclease activity, e.g., through mutation, systems or complexes wherein there is one or more NLS and/or one or more NES; functional domain(s) linked to split Cas9; methods, including methods of treatment, and uses.

An inducer energy source may be considered to be simply an inducer or a dimerizing agent. The term 'inducer energy source' is used herein throughout for consistency. The inducer energy source (or inducer) acts to reconstitute the enzyme. In some embodiments, the inducer energy source brings the two parts of the enzyme together through the action of the two halves of the inducible dimer. The two halves of the inducible dimer therefore are brought tougher in the presence of the inducer energy source. The two halves of the dimer will not form into the dimer (dimerize) without the inducer energy source.

Thus, the two halves of the inducible dimer cooperate with the inducer energy source to dimerize the dimer. This in turn reconstitutes the CRISPR by bringing the first and second parts of the CRISPR together.

The CRISPR protein fusion constructs each comprise one part of the split CRISPR protein. These are fused, preferably via a linker such as a GlySer linker described herein, to one of the two halves of the dimer. The two halves of the dimer may be substantially the same two monomers that together that form the homodimer, or they may be different monomers that together form the heterodimer. As such, the two monomers can be thought of as one half of the full dimer.

The CRISPR protein is split in the sense that the two parts of the CRISPR protein enzyme substantially comprise a functioning CRISPR protein. That CRISPR protein may function as a genome editing enzyme (when forming a complex with the target DNA and the guide), such as a nickase or a nuclease (cleaving both strands of the DNA), or it may be a dead-CRISPR protein which is essentially a DNA-binding protein with very little or no catalytic activity, due to typically mutation(s) in its catalytic domains.

The two parts of the split CRISPR protein can be thought of as the N' terminal part and the C' terminal part of the split CRISPR protein. The fusion is typically at the split point of the CRISPR protein. In other words, the C' terminal of the N' terminal part of the split CRISPR protein is fused to one of the dimer halves, whilst the N' terminal of the C' terminal part is fused to the other dimer half.

The CRISPR protein does not have to be split in the sense that the break is newly created. The split point is typically designed in silico and cloned into the constructs. Together, the two parts of the split CRISPR protein, the N' terminal and C' terminal parts, form a full CRISPR protein, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired CRISPR protein function is restored or reconstituted.

The dimer may be a homodimer or a heterodimer.

One or more, preferably two, NLSs may be used in operable linkage to the first CRISPR protein construct. One or more, preferably two, NESs may be used in operable linkage to the first Cas construct. The NLSs and/or the NESs preferably flank the split Cas-dimer (e.g., half dimer) fusion, i.e., one NLS may be positioned at the N' terminal of the first CRISPR protein construct and one NLS may be at the C' terminal of the first CRISPR protein construct. Similarly, one NES may be positioned at the N' terminal of the second CRISPR construct and one NES may be at the C' terminal of the second CRISPR construct. Where reference is made to N' or C' terminals, it will be appreciated that these correspond to 5' ad 3' ends in the corresponding nucleotide sequence.

A preferred arrangement is that the first CRISPR protein construct is arranged 5'-NLS-(N' terminal CRISPR protein part)-linker-(first half of the dimer)-NLS-3'. A preferred arrangement is that the second CRISPR protein construct is arranged 5'-NES—(second half of the dimer)-linker-(C' terminal CRISPR protein part)-NES-3'. A suitable promoter is preferably upstream of each of these constructs. The two constructs may be delivered separately or together.

In some embodiments, one or all of the NES(s) in operable linkage to the second Cas construct may be swapped out for an NLS. However, this may be typically not preferred and, in other embodiments, the localization signal in operable linkage to the second Cas construct is one or more NES(s).

It will also be appreciated that the NES may be operably linked to the N' terminal fragment of the split CRISPR protein and that the NLS may be operably linked to the C' terminal fragment of the split CRISPR protein. However, the arrangement where the NLS is operably linked to the N' terminal fragment of the split Cas and that the NES is operably linked to the C' terminal fragment of the split CRISPR protein may be preferred.

The NES functions to localize the second CRISPR protein fusion construct outside of the nucleus, at least until the inducer energy source is provided (e.g., at least until an energy source is provided to the inducer to perform its function). The presence of the inducer stimulates dimerization of the two CRISPR protein fusions within the cytoplasm and makes it thermodynamically worthwhile for the dimerized, first and second, CRISPR protein fusions to localize to the nucleus. Without being bound by theory, Applicants believe that the NES sequesters the second CRISPR protein fusion to the cytoplasm (i.e., outside of the nucleus). The NLS on the first CRISPR protein fusion localizes it to the nucleus. In both cases, Applicants use the NES or NLS to shift an equilibrium (the equilibrium of nuclear transport) to a desired direction. The dimerization typically occurs outside of the nucleus (a very small fraction might happen in the nucleus) and the NLSs on the dimerized complex shift the equilibrium of nuclear transport to nuclear localization, so the dimerized and hence reconstituted CRISPR protein enters the nucleus.

Beneficially, Applicants are able to reconstitute function in the split CRISPR protein. Transient transfection is used to prove the concept and dimerization occurs in the background in the presence of the inducer energy source. No activity is seen with separate fragments of the CRISPR protein. Stable expression through lentiviral delivery is then used to develop this and show that a split CRISPR protein approach can be used.

This present split CRISPR protein approach is beneficial as it allows the CRISPR protein activity to be inducible, thus allowing for temporal control. Furthermore, different localization sequences may be used (i.e., the NES and NLS as preferred) to reduce background activity from auto-assembled complexes. Tissue specific promoters, for example one for each of the first and second CRISPR protein fusion constructs, may also be used for tissue-specific targeting, thus providing spatial control. Two different tissue specific promoters may be used to exert a finer degree of control if required. The same approach may be used in respect of stage-specific promoters or there may a mixture of stage and tissue specific promoters, where one of the first and second Cas fusion constructs is under the control of (i.e. operably linked to or comprises) a tissue-specific promoter, whilst the other of the first and second Cas fusion constructs is under the control of (i.e. operably linked to or comprises) a stage-specific promoter.

The inducible CRISPR protein CRISPR-Cas system comprises one or more nuclear localization sequences (NLSs), as described herein, for example as operably linked to the first CRISPR protein fusion construct. These nuclear localization sequences are ideally of sufficient strength to drive accumulation of said first CRISPR protein fusion construct in a detectable amount in the nucleus of a eukaryotic cell. Without wishing to be bound by theory, it is believed that a nuclear localization sequence is not necessary for CRISPR-Cas complex activity in eukaryotes, but that including such sequences enhances activity of the system, especially as to targeting nucleic acid molecules in the nucleus, and assists with the operation of the present 2-part system.

Equally, the second CRISPR protein fusion construct is operably linked to a nuclear export sequence (NES). Indeed, it may be linked to one or more nuclear export sequences. In other words, the number of export sequences used with the second CRISPR protein fusion construct is preferably 1 or 2 or 3. Typically 2 is preferred, but 1 is enough and so is preferred in some embodiments. Suitable examples of NLS and NES are known in the art. For example, a preferred nuclear export signal (NES) is human protein tyrosine kinase 2. Preferred signals will be species specific.

Where the FRB and FKBP system are used, the FKBP is preferably flanked by nuclear localization sequences (NLSs). Where the FRB and FKBP system are used, the preferred arrangement is N' terminal CRISPR protein—FRB—NES. C' terminal Cas-FKBP-NLS. Thus, the first CRISPR protein fusion construct would comprise the C' terminal CRISPR protein part and the second CRISPR protein fusion construct would comprise the N' terminal CRISPR protein part.

Another beneficial aspect to the present invention is that it may be turned on quickly, i.e. that is has a rapid response. It is believed, without being bound by theory, that CRISPR protein activity can be induced through dimerization of existing (already present) fusion constructs (through contact with the inducer energy source) more rapidly than through the expression (especially translation) of new fusion constructs. As such, the first and second CRISPR protein fusion constructs may be expressed in the target cell ahead of time, i.e. before CRISPR protein activity is required. CRISPR protein activity can then be temporally controlled and then quickly constituted through addition of the inducer energy source, which ideally acts more quickly (to dimerize the heterodimer and thereby provide CRISPR protein activity) than through expression (including induction of transcription) of CRISPR protein delivered by a vector, for example.

Applicants demonstrate that CRISPR protein can be split into two components, which reconstitute a functional nuclease when brought back together. Employing rapamycin sensitive dimerization domains, Applicants generate a chemically inducible CRISPR protein for temporal control of CRISPR protein-mediated genome editing and transcription modulation. Put another way, Applicants demonstrate that CRISPR protein can be rendered chemically inducible by being split into two fragments and that rapamycin-sensitive dimerization domains may be used for controlled reassembly of the CRISPR protein. Applicants show that the re-assembled CRISPR protein may be used to mediate genome editing (through nuclease/nickase activity) as well as transcription modulation (as a DNA-binding domain, the so-called "dead CRISPR protein").

As such, the use of rapamycin-sensitive dimerization domains is preferred. Reassembly of the CRISPR protein is preferred. Reassembly can be determined by restoration of binding activity. Where the CRISPR protein is a nickase or induces a double-strand break, suitable comparison percentages compared to a wildtype are described herein.

Rapamycin treatments can last 12 days. The dose can be 200 nM. This temporal and/or molar dosage is an example of an appropriate dose for Human embryonic kidney 293FT (HEK293FT) cell lines and this may also be used in other cell lines. This figure can be extrapolated out for therapeutic use in vivo into, for example, mg/kg. However, it is also envisaged that the standard dosage for administering rapamycin to a subject is used here as well. By the "standard dosage", it is meant the dosage under rapamycin's normal therapeutic use or primary indication (i.e. the dose used when rapamycin is administered for use to prevent organ rejection).

It is noteworthy that the preferred arrangement of CRISPR protein-FRB/FKBP pieces are separate and inactive until rapamycin-induced dimerization of FRB and FKBP results in reassembly of a functional full-length CRISPR protein nuclease. Thus, it is preferred that first CRISPR protein fusion construct attached to a first half of an inducible heterodimer is delivered separately and/or is localized separately from the second Cas fusion construct attached to a first half of an inducible heterodimer.

To sequester the CRISPR protein (N)-FRB fragment in the cytoplasm, where it is less likely to dimerize with the nuclear-localized Cas (C)-FKBP fragment, it is preferable to use on CRISPR protein (N)-FRB a single nuclear export sequence (NES) from the human protein tyrosine kinase 2 (CRISPR protein (N)—FRB-NES). In the presence of rapamycin, CRISPR protein (N)—FRB-NES dimerizes with CRISPR protein (C)-FKBP-2×NLS to reconstitute a complete CRISPR protein, which shifts the balance of nuclear trafficking toward nuclear import and allows DNA targeting.

In some aspects or embodiments, an inducible system for providing a CRISPR protein may be used. In some embodiments, the CRISPR protein is capable, in the presence of an inducer energy source, of forming a CRISPR complex with a target sequence and polynucleotides engineered to complex with the CRISPR protein and the target sequence. In some embodiments, the inducible system comprises: a first fusion protein, or polynucleotides encoding it; and a second fusion protein, or polynucleotides encoding it. In some embodiments, the first fusion protein comprises a first portion of the CRISPR protein, a first half of an inducible dimer and one or more Nuclear Localization Sequences (NLS); and the second fusion protein comprises a second portion of the CRISPR protein, a second half of the inducible dimer and one or more Nuclear Export Sequences (NES). In some embodiments, contact with the inducer energy source brings the first and second portions of the inducible dimer together, so as to bring the first and second portions of the CRISPR protein together, such that the CRISPR protein is thereby capable of forming the CRISPR complex. In some embodiments, the CRISPR protein or the CRISPR system is inducible. In some embodiments, the CRISPR protein may be provided as a single 'part.' In some embodiments, delivery of the CRISPR protein is in protein (including in RNP complex with the polynucleotides) or in nucleotide form (including in mRNA form). In some embodiments, polynucleotides encoding the first fusion protein and polynucleotides encoding second fusion protein are provided on same or different constructs. WO2015/089427 describes an inducible CRISPR-Cas system based on an inducible dimer, which can be a homodimer or heterodimer. The system is also described in Zetsche et al. (Nature Biotechnology 33: 139-142 (2015) DOI: doi:10.1038/nbt.3149). Basically, the CRISPR effector protein is split into two parts, each of which is fused to one half of an inducible dimer, whereby contact with an inducer energy source brings the first and second halves of the inducible dimer together, and bringing the first and second halves of the inducible dimer together allows the first and second CRISPR effector fusion constructs to constitute a functional CRISPR-Cas system, wherein the CRISPR-Cas system comprises a guide RNA (gRNA) comprising a guide sequence capable of hybridizing to a target sequence in a genomic locus of interest in a cell, and wherein the functional CRISPR-Cas system binds to the genomic locus. In particular embodiments, the functional CRISPR-Cas system edits the genomic locus to alter gene expression. In particular embodiments the first half is an FKBP and the second half is an FRB. An inducer energy source may be considered to be simply an inducer or a dimerizing agent as it acts to reconstitute the CRISPR effector protein.

Examples of inducers include light and hormones. A preferred example of first and second light-inducible dimer halves is the CIB1 and CRY2 system. The CIB1 domain is a heterodimeric binding partner of the light-sensitive Cryptochrome 2 (CRY2). In another example, the blue light-responsive Magnet dimerization system (pMag and nMag) may be fused to the two parts of a split Cas protein. In response to light stimulation, pMag and nMag dimerize and Cas reassembles. For example, such system is described in connection with Cas9 in Nihongaki et al. (Nat. Biotechnol. 33, 755-790, 2015). The inducer energy source may be heat, ultrasound, electromagnetic energy or chemical. In a preferred embodiment the inducer energy source may be an antibiotic, a small molecule, a hormone, a hormone derivative, a steroid or a steroid derivative. In a more preferred embodiment, the inducer energy source maybe abscisic acid (ABA), doxycycline (DOX), cumate, rapamycin, 4-hydroxytamoxifen (4OHT), estrogen or ecdysone. The at least one switch may be selected from the group consisting of antibiotic based inducible systems, electromagnetic energy based inducible systems, small molecule based inducible systems, nuclear receptor based inducible systems and hormone based inducible systems. In a more preferred embodiment the at least one switch may be selected from the group consisting of tetracycline (Tet)/DOX inducible systems, light inducible systems, ABA inducible systems, cumate repressor/operator systems, 4OHT/estrogen inducible systems, ecdysone-based inducible systems and FKBP12/FRAP (FKBP12-rapamycin complex) inducible systems. Such inducers are also discussed herein and in PCT/US2013/051418, incorporated herein by reference.

Also, it is described in WO2015/089427 that the half of an inducible dimer can be linked to the effector protein with a linker. Optionally, the CRISPR effector protein has reduced or no nuclease activity, e.g. contains one or more inactivating mutations. Further it is described that one or more functional domains can be associated with one or both parts of the effector protein, WO2015/089427 identifies split points within SpCas9. Similar suitable split points can be identified for Cas.

The following table presents non-limiting potential split regions within As and LbCpf1. A split site within such a region may be opportune.

TABLE 10

| Split region | AsCpf1 | LbCpf1 |
| --- | --- | --- |
| 1 | 575-588 | 566-571 |
| 2 | 631-645 | 754-757 |
| 3 | 653-664 | — |
| 4 | 818-844 | — |

For Fn, As and Lb Cpf1 mutants, it should be readily apparent what the corresponding position for a potential split site is, for example, based on a sequence alignment. For non-Fn, As and Lb enzymes one can use the crystal structure of an ortholog if a relatively high degree of homology exists between the ortholog and the intended Cpf1, or one can use computational prediction.

Further it is described that the first and second fusion constructs of the CRISPR effector protein can be delivered in the same or separate vectors. In particular embodiments, a first half of the inducible dimer is fused to one or more nuclear localization constructs while the second half is fused to one or more nuclear export signals.

The therapeutic methods which involve the use of the inducible dimer comprise the step of administering the vectors comprising the first and second fusion constructs to the subject and administering an inducer energy source to the subject. In particular embodiments, the inducer energy source is rapamycin. It is further envisaged that the methods can involve administering, a repair template, in the same or a different vector as the inducible dimer fragments. An exemplary treatment regimen with Rapamycin can last 12 days.

The use of the split Cas effector protein system described herein allows a further control of the CRISPR-Cas activity. More particularly the use of an inducible system allows for temporal control. In addition, the use of different localization sequences (i.e., the NES and NLS as preferred) can reduce background activity from auto-assembled complexes. Tissue specific promoters, allow for spatial control. Two different tissue specific promoters may be used to exert a finer degree of control if required.

g. Use of Self-Inactivating Systems

Once all copies of a gene in the genome of a cell have been edited, continued CRISPR/Cas expression in that cell is no longer necessary. Indeed, sustained expression is undesirable to avoid off-target effects and other toxicity issues. WO 2015089351 describes self-Inactivating CRISPR systems which rely on the use of a non-coding guide target sequence within the CRISPR vector itself. Thus, after expression begins, the CRISPR system will lead to its own destruction, but before destruction is complete it will have time to edit the genomic copies of the target gene (which, with a normal point mutation in a diploid cell, requires at most two edits). Accordingly, the methods may involve the use of a self-inactivating CRISPR-Cas system which includes one additional RNA (i.e., guide RNA) that targets the coding sequence for the CRISPR enzyme itself or that targets one or more non-coding guide target sequences complementary to unique sequences present in within the promoter driving expression of the non-coding RNA elements, within the promoter driving expression of the Cas gene, within 100 bp of the ATG translational start codon in the Cas coding sequence, or within the inverted terminal repeat (iTR) of a viral delivery vector, e.g., in the AAV genome.

Similarly, self-inactivating systems which make use of "governing guides" are exemplified in relation to Cas9 in US2015232881A1 (also published as WO2015070083 (A1) referenced elsewhere herein and incorporated herein by reference, and may be extrapolated to Cas. More particularly Methods and compositions that use, or include, a nucleic acid, e.g., a DNA, that encodes a Cas molecule or a gRNA molecule, can, in addition, use or include a "governing gRNA molecule." The governing gRNA molecule can complex with the Cpf1 molecule to inactivate or silence a component of a CRISPR-Cas system. The additional gRNA molecule, referred to herein as a governing gRNA molecule, comprises a targeting domain which targets a component of the CRISPR-Cas system. In an embodiment, the governing gRNA molecule targets and silences (1) a nucleic acid that encodes a Cas molecule), (2) a nucleic acid that encodes a gRNA molecule (i.e., a gRNA-targeting gRNA molecule), or (3) a nucleic acid sequence engineered into the Cas components that is designed with minimal homology to other nucleic acid sequences in the cell to minimize off-target cleavage (i.e., an engineered control sequence-targeting gRNA molecule).

The targeting sequence for the governing gRNA can be selected to increase regulation or control of the Cas system and/or to reduce or minimize off-target effects of the system. For example, a governing gRNA can minimize undesirable cleavage, e.g., "recleavage" after Cas mediated alteration of a target nucleic acid or off-target cutting of Cas, by inactivating (e.g., cleaving) a nucleic acid that encodes a Cas molecule. In an embodiment, a governing gRNA places temporal or other limit(s) on the level of expression or activity of the Cas molecule/gRNA molecule complex. In an embodiment, the governing gRNA reduces off-target or other unwanted activity.

The additional guide RNA can be delivered via a vector, e.g., a separate vector or the same vector that is encoding the CRISPR complex. When provided by a separate vector, the CRISPR RNA that targets Cas expression can be administered sequentially or simultaneously. When administered sequentially, the CRISPR RNA that targets Cas expression is to be delivered after the CRISPR RNA that is intended for e.g. gene editing or gene engineering. This period may be a period of minutes (e.g. 5 minutes, 10 minutes, 20 minutes, 30 minutes, 45 minutes, 60 minutes). This period may be a period of hours (e.g. 2 hours, 4 hours, 6 hours, 8 hours, 12 hours, 24 hours). This period may be a period of days (e.g. 2 days, 3 days, 4 days, 7 days). This period may be a period of weeks (e.g. 2 weeks, 3 weeks, 4 weeks). This period may be a period of months (e.g. 2 months, 4 months, 8 months, 12 months). This period may be a period of years (2 years, 3 years, 4 years). In this fashion, the Cas enzyme associates with a first gRNA capable of hybridizing to a first target, such as a genomic locus or loci of interest and undertakes the function(s) desired of the CRISPR-Cas system (e.g., gene engineering); and subsequently the Cas 1 enzyme may then associate with the second gRNA capable of hybridizing to the sequence comprising at least part of the Cas or CRISPR cassette. Where the gRNA targets the sequences encoding expression of the Cas protein, the enzyme becomes impeded and the system becomes self-inactivating. In the same manner, CRISPR RNA that targets Cas expression applied via, for example liposome, lipofection, nanoparticles, microvesicles as explained herein, may be administered sequentially or simultaneously. Similarly, self-inactivation may be used for inactivation of one or more guide RNA used to target one or more targets.

In some embodiments, a single gRNA is provided that is capable of hybridization to a sequence downstream of a CRISPR enzyme start codon, whereby after a period of time there is a loss of the CRISPR enzyme expression. In some embodiments, one or more gRNA(s) are provided that are capable of hybridization to one or more coding or non-coding regions of the polynucleotide encoding the CRISPR-Cas system, whereby after a period of time there is a inactivation of one or more, or in some cases all, of the CRISPR-Cas systems. In some aspects of the system, and not to be limited by theory, the cell may comprise a plurality of CRISPR-Cas complexes, wherein a first subset of CRISPR complexes comprise a first chiRNA capable of targeting a genomic locus or loci to be edited, and a second subset of CRISPR complexes comprise at least one second chiRNA capable of targeting the polynucleotide encoding the CRISPR-Cas system, wherein the first subset of CRISPR-Cas complexes mediate editing of the targeted genomic locus or loci and the second subset of CRISPR complexes eventually inactivate the CRISPR-Cas system, thereby inactivating further CRISPR-Cas expression in the cell.

Thus the invention provides a CRISPR-Cas system comprising one or more vectors for delivery to a eukaryotic cell, wherein the vector(s) encode(s): (i) a CRISPR enzyme; (ii) a first guide RNA capable of hybridizing to a target sequence in the cell; (iii) a second guide RNA capable of hybridizing to one or more target sequence(s) in the vector which encodes the CRISPR enzyme; (iv) at least one tracr mate sequence; and (v) at least one tracr sequence, The first and second complexes can use the same tracr and tracr mate, thus differing only by the guide sequence, wherein, when expressed within the cell: the first guide RNA directs sequence-specific binding of a first CRISPR complex to the target sequence in the cell; the second guide RNA directs sequence-specific binding of a second CRISPR complex to the target sequence in the vector which encodes the CRISPR enzyme; the CRISPR complexes comprise (a) a tracr mate sequence hybridized to a tracr sequence and (b) a CRISPR enzyme bound to a guide RNA, such that a guide RNA can hybridize to its target sequence; and the second CRISPR complex inactivates the CRISPR-Cas system to prevent continued expression of the CRISPR enzyme by the cell. The CRISPR enzyme can be Cpf1, particularly FnCpf1 or AsCpf1.

Further characteristics of the vector(s), the encoded enzyme, the guide sequences, etc. are disclosed elsewhere herein. For instance, one or both of the guide sequence(s) can be part of a chiRNA sequence which provides the guide, tracr mate and tracr sequences within a single RNA, such that the system can encode (i) a CRISPR enzyme; (ii) a first chiRNA comprising a sequence capable of hybridizing to a first target sequence in the cell, a first tracr mate sequence, and a first tracr sequence; (iii) a second guide RNA capable of hybridizing to the vector which encodes the CRISPR enzyme, a second tracr mate sequence, and a second tracr sequence. Similarly, the enzyme can include one or more NLS, etc.

The various coding sequences (CRISPR enzyme, guide RNAs, tracr and tracr mate) can be included on a single vector or on multiple vectors. For instance, it is possible to encode the enzyme on one vector and the various RNA sequences on another vector, or to encode the enzyme and one chiRNA on one vector, and the remaining chiRNA on another vector, or any other permutation. In general, a system using a total of one or two different vectors is preferred.

Where multiple vectors are used, it is possible to deliver them in unequal numbers, and ideally with an excess of a vector which encodes the first guide RNA relative to the second guide RNA, thereby assisting in delaying final inactivation of the CRISPR system until genome editing has had a chance to occur.

Thus the target sequence in the vector must be capable of inactivating expression of the CRISPR effector protein. Suitable target sequences can be, for instance, near to or within the translational start codon for the Cas coding sequence, in a non-coding sequence in the promoter driving expression of the non-coding RNA elements, within the promoter driving expression of the Cas gene, within 100 bp of the ATG translational start codon in the Cas coding sequence, and/or within the inverted terminal repeat (iTR) of a viral delivery vector, e.g., in the AAV genome. A double stranded break near this region can induce a frame shift in the Cas coding sequence, causing a loss of protein expression. An alternative target sequence for the "self-inactivating" guide RNA would aim to edit/inactivate regulatory regions/sequences needed for the expression of the CRISPR-Cas system or for the stability of the vector. For instance, if the promoter for the Cas coding sequence is disrupted then transcription can be inhibited or prevented. Similarly, if a vector includes sequences for replication, maintenance or stability then it is possible to target these. For instance, in a AAV vector a useful target sequence is within the iTR. Other useful sequences to target can be promoter sequences, polyadenylation sites, etc.

Furthermore, if the guide RNAs are expressed in array format, the "self-inactivating" guide RNAs that target both promoters simultaneously will result in the excision of the intervening nucleotides from within the CRISPR-Cas expression construct, effectively leading to its complete inactivation. Similarly, excision of the intervening nucleotides will result where the guide RNAs target both ITRs, or targets two or more other CRISPR-Cas components simultaneously. Self-inactivation as explained herein is applicable, in general, with CRISPR-Cas systems in order to provide regulation of the CRISPR-Cas. For example, self-inactivation as explained herein may be applied to the CRISPR repair of mutations, for example expansion disorders, as explained herein. As a result of this self-inactivation, CRISPR repair is only transiently active.

Addition of non-targeting nucleotides to the 5' end (e.g. 1-10 nucleotides, preferably 1-5 nucleotides) of the "self-inactivating" guide RNA can be used to delay its processing and/or modify its efficiency as a means of ensuring editing at the targeted genomic locus prior to CRISPR-Cas shut-down.

In one aspect of the self-inactivating AAV-CRISPR-Cas system, plasmids that co-express one or more sgRNA targeting genomic sequences of interest (e.g. 1-2, 1-5, 1-10, 1-15, 1-20, 1-30) may be established with "self-inactivating" sgRNAs that target a Cas sequence at or near the engineered ATG start site (e.g. within 5 nucleotides, within 15 nucleotides, within 30 nucleotides, within 50 nucleotides, within 100 nucleotides). A regulatory sequence in the U6 promoter region can also be targeted with an sgRNA. The U6-driven sgRNAs may be designed in an array format such that multiple sgRNA sequences can be simultaneously released. When first delivered into target tissue/cells (left cell) sgRNAs begin to accumulate while Cas 1 protein levels rise in the nucleus. Cas complexes with all of the sgRNAs to mediate genome editing and self-inactivation of the CRISPR-Cas plasmids.

One aspect of a self-inactivating CRISPR-Cas system is expression of singly or in tandem array format from 1 up to 4 or more different guide sequences; e.g. up to about 20 or about 30 guides sequences. Each individual self-inactivating guide sequence may target a different target. Such may be processed from, e.g. one chimeric pol3 transcript. Pol3 promoters such as U6 or H1 promoters may be used. Pol2 promoters such as those mentioned throughout herein. Inverted terminal repeat (iTR) sequences may flank the Pol3 promoter—sgRNA(s)-Pol2 promoter-Cas9.

In particular embodiments one or more guide(s) edit the one or more target(s) while one or more self-inactivating guides inactivate the CRISPR/Cas system. Thus, for example, the described CRISPR-Cas system for repairing expansion disorders may be directly combined with the self-inactivating CRISPR-Cas system described herein. Such a system may, for example, have two guides directed to the target region for repair as well as at least a third guide directed to self-inactivation of the CRISPR-Cas. Reference is made to Application Ser. No. PCT/US2014/069897, entitled "Compositions And Methods Of Use Of Crispr-Cas Systems In Nucleotide Repeat Disorders," published Dec. 12, 2014 as WO/2015/089351.

In particular embodiments, the gene editing systems described herein are placed under the control of a passcode kill switch, which is a mechanism which efficiently kills the host cell when the conditions of the cell are altered. This is ensured by introducing hybrid LacI-GalR family transcription factors, which require the presence of IPTG to be switched on (Chan et al. 2015 Nature Chemical Biology doi:10.1038/nchembio.1979 which can be used to drive a gene encoding an enzyme critical for cell-survival. By combining different transcription factors sensitive to different chemicals, a "code" can be generated. This system can be used to spatially and temporally control the extent of CRISPR-induced genetic modifications, which can be of interest in different fields including therapeutic applications and may also be of interest to avoid the "escape" of GMOs from their intended environment.

h. Use of "Off-Switches"

In particular embodiments, it may be possible to make use of specific inhibitors and/or agonist of Cas. Off-switches and On-switches may be any molecules (i.e. peptides, proteins, small molecules, nucleic acids) capable of interfering with or acting as an agonist for any aspect of the Cas9 effector protein. For instance, Pawluck et al. 2016 (Cell 167, 1-10) describe mobile elements from bacteria that encode protein inhibitors of Cas9. Three families of anti-CRISPRs were found to inhibit N. meningitidis Cas9 in vivo and in vitro. The anti-CRISPRs bind directly to NmeCas9. These proteins are described to be potent "off-switches" for NmeCas9 genome editing in human cells. Methods for identifying small molecules which affect efficiency of Cas9 are described for example by Yu et al. (Cell Stem Cell 16, 142-147, 2015). In certain embodiments small molecules may be used for control Cas9. Maji et al. describe a small molecule-regulated protein degron domain to control Cas9 system editing. Maji et al. "Multidimensional chemical control of CRISPR-Cas9" Nature Chemical Biology (2017) 13:9-12. In certain example embodiments, the inhibitor may be a bacteriophage derived protein. See Rauch et al. "Inhibition of CRISPR-Cas9 with Bacteriophage Proteins" Cell (2017) 168(2):150-158. In certain example embodiments, the anti-CRISPR may inhibit CRISPR-Cas systems by binding to guide molecules. See Shin et al. "Disabling Cas9 by an anti-CRISPR DNA mimic" bioRxiv, Apr. 22, 2017, doi: dx.doi.org/10.1101/129627.

In particular embodiments, intracellular DNA is removed by genetically encoded DNai which responds to a transcriptional input and degrades user-defined DNA as described in Caliando & Voigt, Nature Communications 6: 6989 (2015).

Efficacy a. Enzyme Stability

The level of expression of a protein is dependent on many factors, including the quantity of mRNA, its stability and rates of ribosome initiation. The stability or degradation of mRNA is an important factor. Several strategies have been described to increase mRNA stability. One aspect is codon-optimization. It has been found that GC-rich genes are expressed several-fold to over a 100-fold more efficiently than their GC-poor counterparts. This effect could be directly attributed to increased steady-state mRNA levels, and more particularly to efficient transcription or mRNA processing (not decreased degradation) (Kudla et al. Plos Biology dx.doi.org/10.1371/journal.pbio.0040180). Also, it has been found that ribosomal density has a significant effect on the transcript half-life. More particularly, it was found that an increase in stability can be achieved through the incorporation of nucleotide sequences that are capable of forming secondary structures, which often recruit ribosomes, which impede mRNA degrading enzymes. WO2011/141027 describes that slowly-read codons can be positioned in such a way as to cause high ribosome occupancy across a critical region of the 5' end of the mRNA can increase the half-life of a message by as much as 25%, and produce a similar uplift in protein production. In contrast, positioning even a single slow-read codon before this critical region can significantly destabilize the mRNA and result in an attenuation of protein expression. This understanding enables the design of mRNAs so as to suit the desired functionality. In addition, chemical modifications such as those described for guide sequences herein can be envisaged to increase mRNA stability.

b. Guide Stability

In certain embodiments, the methods make use of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs father include, without limitation, RNAs with phosphorothioate linkages and locked nucleic acid (LNA) nucleotides comprising a methylene bridge between the 2' and 4' carbons of the ribose ring.

Selection of Target Sites in Gene a) Selection within a Target Gene

Studies to date suggest that while sgRNA activity can be quite high, there is significant variability among sgRNAs in their ability to generate the desired target cleavage. Efforts have been made to identify design criteria to maximize guide RNA efficacy. Doench et al. (Nat Biotechnol. 2014 Decemeber; 32(12): 1262-1267 and Nat Biotechnol. PubMed PMID: 26780180) describe the development of a quantitative model to optimize sgRNA activity prediction, and a tool to use this model for sgRNA design. Accordingly, in particular embodiments, the methods provided herein comprise identifying an optimal guide sequence based on a statistical comparison of active guide RNAs, such as described by Doench et al. (above). In particular embodiments, at least five gRNAs are designed per target and these are tested empirically in cells to generate at least one which has sufficiently high activity.

b) Identification of Suitable Guide Sequence

Currently RNA guides are designed using the reference human genome; however, failing to take into account variation in the human population may confound the therapeutic outcome for a given RNA guide. The recently released ExAC dataset, based on 60,706 individuals, contains on average one variant per eight nucleotides in the human exome (Lek, M. et al. Analysis of protein-coding genetic variation in 60,706 humans. Nature 536, 285-291 (2016)). This highlights the potential for genetic variation to impact the efficacy of certain RNA guides across patient populations for CRISPR-based gene therapy, due to the presence of mismatches between the RNA guide and variants present in the target site of specific patients. To assess this impact, we use the ExAC dataset to catalog variants present in all possible targets in the human reference exome that either (i) disrupt the target PAM sequence or (ii) introduce mismatches between the RNA guide and the genomic DNA, which can collectively be termed target variation. For treatment of a patient population, avoiding target variation for RNA guides administered to individual patients will maximize the consistency of outcomes for a genome editing therapeutic. The demonstration of the impact of target variation is illustrated in the examples section herein.

Ideally, personalized genomic medicine would tailor RNA-guided endonuclease therapeutics for each patient. However, it would likely be cost-prohibitive and infeasible from a regulatory standpoint to design an individual RNA guide for each patient receiving a genome editing therapy. The analysis of the impact of genetic variation on the efficacy and safety of RNA-guided endonucleases motivates the following framework to streamline the design and testing of genome editing therapeutics. First, use of RNA guides for platinum targets would ensure perfect targeting for 99.99% of patients. Second, these RNA guides need to be further selected to minimize the number of off-target candidates occurring on high frequency haplotypes in the patient population. Third, low frequency variation captured in large scale sequencing datasets can be used to estimate the number of guide RNA-enzyme combinations required to effectively and safely treat different sizes of patient populations. Growth of large scale sequencing datasets will improve the accuracy of these estimates. Fourth, pre-therapeutic whole genome sequencing of individual patients will be needed to select a single approved guide RNA-enzyme combination for treatment. This combination should be a perfect match to the patient's genome and be free of patient-specific off-target candidates. This framework, in combination with rapidly accumulating human sequencing data, which will further refine these selection criteria, will enable the design and validation of genome editing therapeutics minimizing both the number of guide RNA-enzyme combinations necessary for approval and the cost of delivering effective and safe gene therapies to patients.

Accordingly, in particular embodiments, the methods provided herein comprise one or more of the following steps: (1) identifying platinum targets, (2) selection of the guides to minimize the number of off-target candidates occurring on high frequency haplotypes in the patient population; (3) select guide (and/or effector protein) based low frequency variation captured in large scale sequencing datasets to estimate the number of guide RNA-enzyme combinations required to effectively and safely treat different sizes of patient populations, and (4) confirm or select guide based on pre-therapeutic whole genome sequencing of individual patient. In particular embodiments, a "platinum" target is one that does not contain variants occurring at >0.01% allele frequency.

Effector Protein Functioning as Target-Binding Protein Effector Protein Lacking Nuclease Activity As described herein, corresponding catalytic domains of a Cas effector protein may also be mutated to produce a mutated Cas effector protein lacking all DNA cleavage activity or having substantially reduced DNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type V/Type VI CRISPR system. Most preferably, the effector protein is Cas. In further embodiments, the effector protein is a Type V protein. By derived, Applicants mean that the derived enzyme is largely based, in the sense of having a high degree of sequence homology with, a wildtype enzyme, but that it has been mutated (modified) in some way as known in the art or as described herein.

In particular embodiments the Cas effector protein comprise one or more heterologous functional domains. The one or more heterologous functional domains may comprise one or more nuclear localization signal (NLS) domains. The one or more heterologous functional domains may comprise at least two or more NLSs. The one or more heterologous functional domains may comprise one or more transcriptional activation domains. A transcriptional activation domain may comprise VP64. The one or more heterologous functional domains may comprise one or more transcriptional repression domains. A transcriptional repression domain may comprise a KRAB domain or a SID domain. The one or more heterologous functional domain may comprise one or more nuclease domains. The one or more nuclease domains may comprise Fok1.

For the purposes of the following discussion, reference to a functional domain could be a functional domain associated with the CRISPR enzyme or a functional domain associated with the adaptor protein.

In the practice of the invention and as will be described below, loops of the gRNA may be extended, without colliding with the Cas (e.g. Cpf1) protein by the insertion of distinct RNA loop(s) or distinct sequence(s) that may recruit adaptor proteins that can bind to the distinct RNA loop(s) or distinct sequence(s). The adaptor proteins may include but are not limited to orthogonal RNA-binding protein/aptamer combinations that exist within the diversity of bacteriophage coat proteins. A list of such coat proteins includes, but is not limited to: QP, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. These adaptor proteins or orthogonal RNA binding proteins can further recruit effector proteins or fusions which comprise one or more functional domains. In some embodiments, the functional domain may be selected from the group consisting of: transposase domain, integrase domain, recombinase domain, resolvase domain, invertase domain, protease domain, DNA methyltransferase domain, DNA hydroxylmethylase domain, DNA demethylase domain, histone acetylase domain, histone deacetylases domain, nuclease domain, repressor domain, activator domain, nuclear-localization signal domains, transcription-regulatory protein (or transcription complex recruiting) domain, cellular uptake activity associated domain, nucleic acid binding domain, antibody presentation domain, histone modifying enzymes, recruiter of histone modifying enzymes; inhibitor of histone modifying enzymes, histone methyltransferase, histone demethylase, histone kinase, histone phosphatase, histone ribosylase, histone deribosylase, histone ubiquitinase, histone deubiquitinase, histone biotinase and histone tail protease. In some preferred embodiments, the functional domain is a transcriptional activation domain, such as, without limitation, VP64, p65, MyoD1, HSF1, RTA, SET7/9 or a histone acetyltransferase. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain. In some embodiments, the functional domain is a deaminase, such as a cytidine deaminase. Cytidine deaminase may be directed to a target nucleic acid to where it directs conversion of cytidine to uridine, resulting in C to T substitutions (G to A on the complementary strand). In such an embodiment, nucleotide substitutions can be affected without DNA cleavage.

Guide RNAs Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Nuclease activity may be measured using surveyor analysis or deep sequencing as commonly used in the art, preferably surveyor analysis. Similarly, dead guide sequences may not sufficiently engage in productive base pairing with respect to the ability to promote catalytic activity or to distinguish on-target and off-target binding activity.

The ability of a dead guide sequence to direct sequence-specific binding of a CRISPR complex to a target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

Several structural parameters allow for a proper framework to arrive at such dead guides. As known in the art, one aspect of gRNA—CRISPR effector protein specificity is the direct repeat sequence, which is to be appropriately linked to such guides. In particular, this implies that the direct repeat sequences are designed dependent on the origin of the CRISPR effector protein. Thus, structural data available for validated dead guide sequences may be used for designing Cas specific equivalents. Structural similarity between, e.g., the orthologous nuclease domains RuvC of two or more Cas effector proteins may be used to transfer design equivalent dead guides. In particular embodiments, the dead guide sequences are shorter than respective guide sequences which result in active Cas-specific indel formation. Dead guides are 5%, 10%, 20%, 30%, 40%, 50%, shorter than respective guides directed to the same Cas leading to active Cas-specific indel formation.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets, for example for activation, repression and/or silencing of gene activity, has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides now allow for the first time to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble a synthetic transcription activation complex consisting of multiple distinct effector domains. Such may be modeled after natural transcription activation processes. For example, an aptamer, which selectively binds an effector (e.g. an activator or repressor; dimerized MS2 bacteriophage coat proteins as fusion proteins with an activator or repressor), or a protein which itself binds an effector (e.g. activator or repressor) may be appended to a dead gRNA tetraloop and/or a stem-loop 2. In the case of MS2, the fusion protein MS2-VP64 binds to the tetraloop and/or stem-loop 2 and in turn mediates transcriptional up-regulation, for example for Neurog2. Other transcriptional activators are, for example, VP64. P65, HSF1, and MyoD1. By mere example of this concept, replacement of the MS2 stem-loops with PP7-interacting stem-loops may be used to recruit repressive elements.

Accordingly, in particular embodiments of the methods provided herein, use is made of a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The gene effectors, gene activators, gene repressors may be present in the form of fusion proteins.

In particular embodiments, the dead gRNA includes a non-naturally occurring or engineered composition comprising two or more adaptor proteins, wherein each protein is associated with one or more functional domains and wherein the adaptor protein binds to the distinct RNA sequence(s) inserted into the at least one loop of the dead gRNA. In certain embodiments, the adaptor protein is a fusion protein comprising the functional domain, the fusion protein optionally comprising a linker between the adaptor protein and the functional domain, the linker optionally including a GlySer linker. In certain embodiments, the one or more functional domains associated with the adaptor protein are selected from: transcriptional activation domains and transcriptional repressor domains. In certain embodiments, the one or more functional domains associated with the adaptor protein are selected from: VP64, p65, MyoD1, HSF1, RTA or SET7/9, KRAB domain, NuE domain, NcoR domain, SID domain or a SID4X domain. In certain embodiments, at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity. In certain embodiments, the DNA cleavage activity is due to a Fok1 nuclease. In certain embodiments, the dead gRNA is modified so that, after dead gRNA binds the adaptor protein and further binds to the Cas and target, the functional domain is in a spatial orientation allowing for the functional domain to function in its attributed function. In certain embodiments, the at least one loop of the dead gRNA is tetra loop and/or loop2. In certain embodiments, the tetra loop and loop 2 of the dead gRNA are modified by the insertion of the distinct RNA sequence (s). In certain embodiments, the insertion of distinct RNA sequence(s) that bind to one or more adaptor proteins is an aptamer sequence. In certain embodiments, the aptamer sequence is two or more aptamer sequences specific to the same adaptor protein. In certain embodiments, the aptamer sequence is two or more aptamer sequences specific to different adaptor protein. In certain embodiments, the adaptor protein comprises MS2, PP7, QP, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. In certain embodiments, a first adaptor protein is associated with a p65 domain and a second adaptor protein is associated with a HSF1 domain. In certain embodiments, the composition comprises a CRISPR-Cas complex having at least three functional domains, at least one of which is associated with the Cas and at least two of which are associated with dead gRNA.

The use of two different aptamers (each associated with a distinct nucleic acid-targeting guide RNAs) allows an activator-adaptor protein fusion and a repressor-adaptor protein fusion to be used, with different nucleic acid-targeting guide RNAs, to activate expression of one DNA or RNA, whilst repressing another. They, along with their different guide RNAs can be administered together, or substantially together, in a multiplexed approach. A large number of such modified nucleic acid-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the nucleic acid-targeting effector protein-guide RNA complex as a whole may be associated with two or more functional domains. For example, there may be two or more functional domains associated with the nucleic acid-targeting effector protein, or there may be two or more functional domains associated with the guide RNA (via one or more adaptor proteins), or there may be one or more functional domains associated with the nucleic acid-targeting effector protein and one or more functional domains associated with the guide RNA (via one or more adaptor proteins).

The fusion between the adaptor protein and the activator or repressor may include a linker. For example, GlySer linkers GGGS (SEQ ID NO: 207) can be used. They can be used in repeats of 3 ((GGGGS)3 (SEQ ID NO: 198)) or 6 (SEQ ID NO: 199), 9 (SEQ ID NO: 200) or even 12 (SEQ ID NO: 201) or more, to provide suitable lengths, as required. Linkers can be used between the guide RNAs and the functional domain (activator or repressor), or between the nucleic acid-targeting Cas protein (Cas) and the functional domain (activator or repressor). The linkers the user to engineer appropriate amounts of "mechanical flexibility".

The invention comprehends a nucleic acid-targeting complex comprising a nucleic acid-targeting effector protein and a guide RNA, wherein the nucleic acid-targeting effector protein comprises at least one mutation, such that the nucleic acid-targeting effector protein has no more than 5% of the activity of the nucleic acid-targeting effector protein not having the at least one mutation and, optional, at least one or more nuclear localization sequences; the guide RNA comprises a guide sequence capable of hybridizing to a target sequence in a RNA of interest in a cell; and wherein: the nucleic acid-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the nucleic acid-targeting Cas protein is associated with one or more functional domains and at least one loop of the guide RNA is modified by the insertion of distinct RNA sequence(s) that bind to one or more adaptor proteins, and wherein the adaptor protein is associated with one or more functional domains.

In certain embodiments, the methods may involve the use of a second gRNA, wherein the second gRNA is a live gRNA capable of hybridizing to a second target sequence such that a second Cas CRISPR-Cas system is directed to a second genomic locus of interest in a cell with detectable indel activity at the second genomic locus resultant from nuclease activity of the Cas enzyme of the system. Accordingly, in certain embodiments, the methods involve a plurality of dead gRNAs and/or a plurality of live gRNAs.

Methods for designing, evaluating, or selecting a dead guide RNA targeting sequence (dead guide sequence) for guiding a CRISPR-Cas system to a target gene locus are described e.g. in WO2016094872, incorporated herein by reference in its entirety.

In particular embodiments, the method of selecting a dead guide RNA targeting sequence for directing a functionalized Cas to a gene locus in an organism, without cleavage, comprises a) locating one or more CRISPR motifs in the gene locus; b) analyzing the sequence downstream of each CRISPR motif by i) selecting 10 to 15 nt adjacent to the CRISPR motif, ii) determining the GC content of the sequence, and c) selecting the 10 to 15 nt sequence as a targeting sequence for use in a dead guide RNA if the GC content of the sequence is 30% more, 40% or more. In certain embodiments, the GC content of the targeting sequence is 35% or more, 40% or more, 45% or more, 50% or more, 55% or more, 60% or more, 65% or more, or 70% or more. In certain embodiments, the GC content of the targeting sequence is from 30% to 40% or from 40% to 50% or from 50% to 60% or from 60% to 70%. In an embodiment of the invention, two or more sequences in a gene locus are analyzed and the sequence having the highest GC content is selected. In an embodiment, the portion of the targeting sequence in which GC content is evaluated is 10 to 15 contiguous nucleotides of the 15 target nucleotides nearest to the PAM. In an embodiment of the invention, the portion of the guide in which GC content is considered is the 10 to 11 nucleotides or 11 to 12 nucleotides or 12 to 13 nucleotides or 13, or 14, or 15 contiguous nucleotides of the 15 nucleotides nearest to the PAM. It has been observed that increased GC content in dead guide RNAs of 16 to 20 nucleotides coincides with increased DNA cleavage and reduced functional activation.

It has been demonstrated herein that efficiency of functionalized Cas can be increased by addition of nucleotides to the 3' end of a guide RNA which do not match a target sequence downstream of the CRISPR motif. For example, of dead guide RNA 11 to 15 nt in length, shorter guides may be less likely to promote target cleavage, but are also less efficient at promoting CRISPR system binding and functional control. It is believed that similar effects can be observed for Cas.

Multiplex (Tandem) Targeting Approach

The inventors have shown that CRISPR enzymes as defined herein can employ more than one RNA guide without losing activity. This enables the use of the CRISPR enzymes, systems or complexes as defined herein for targeting multiple DNA targets, genes or gene loci, with a single enzyme, system or complex as defined herein. The guide RNAs may be tandemly arranged, optionally separated by a nucleotide sequence such as a direct repeat as defined herein. The position of the different guide RNAs is the tandem does not influence the activity.

Accordingly, the Cas enzyme may form part of a CRISPR system or complex, which further comprises tandemly arranged guide RNAs (gRNAs) comprising a series of 2, 3, 4, 5, 6, 7, 8, 9, 10, 15, 25, 25, 30, or more than 30 guide sequences, each capable of specifically hybridizing to a target sequence in a genomic locus of interest in a cell. In some embodiments, the functional Cas CRISPR system or complex binds to the multiple target sequences. In some embodiments, the functional CRISPR system or complex may edit the multiple target sequences, e.g., the target sequences may comprise a genomic locus, and in some embodiments there may be an alteration of gene expression. In some embodiments, the functional CRISPR system or complex may comprise further functional domains. In some embodiments, the invention provides a method for altering or modifying expression of multiple gene products. The method may comprise introducing into a cell containing said target nucleic acids, e.g., DNA molecules, or containing and expressing target nucleic acid, e.g., DNA molecules; for instance, the target nucleic acids may encode gene products or provide for expression of gene products (e.g., regulatory sequences). In some general embodiments, the Cas enzyme used for multiplex targeting is associated with one or more functional domains. In some more specific embodiments, the CRISPR enzyme used for multiplex targeting is a dead Cas as defined herein elsewhere. In some embodiments, each of the guide sequence is at least 16, 17, 18, 19, 20, 25 nucleotides, or between 16-30, or between 16-25, or between 16-20 nucleotides in length.

Examples of multiplex genome engineering using CRISPR effector proteins are provided in Cong et al. (Science February 15;339(6121):819-23 (2013) and other publications cited herein. More specifically, multiplex gene editing using Cas is described in Zetsche et al. 2016 (doi: dx.doi.org/10.1101/049122).

The application provides methods for developing the therapeutic use of a nucleic acid-targeting system. The nucleic acid-targeting complex an effective means for modifying a target DNA or RNA (single or double stranded, linear or super-coiled). The nucleic acid-targeting complex has a wide variety of utility including modifying (e.g., deleting, inserting, translocating, inactivating, activating) a target DNA or RNA in a multiplicity of cell types. As such the nucleic acid-targeting complex has a broad spectrum of applications in, e.g., gene therapy, drug screening, disease diagnosis, and prognosis. An exemplary nucleic acid-targeting complex comprises a DNA or RNA-targeting effector protein complexed with a guide RNA hybridized to a target sequence within the target locus of interest.

The invention involves developing a therapeutic based on the CRISPR system. In particular embodiments, the therapeutic comprises a DNA-targeting effector protein and/or a guide RNA capable of hybridizing to a target sequence of interest. In particular embodiments, the therapeutic is a vector system comprising one or more vectors, wherein the one or more vectors comprises: a) a first regulatory element operably linked to a nucleotide sequence encoding the Cas effector protein; and b) a second regulatory element operably linked to one or more nucleotide sequences encoding one or more nucleic acid molecules comprising a guide RNA comprising a guide sequence, a direct repeat sequence; wherein components (a) and (b) are located on same or different vectors. In particular embodiments, the therapeutic is a composition comprising a delivery system operably configured to deliver CRISPR-Cas complex components or one or more polynucleotide sequences comprising or encoding said components into a cell, and wherein said CRISPR-Cas complex is operable in the cell; CRISPR-Cas complex components, the CRISPR-Cas complex components, comprising (I) the Cas effector protein as described herein; and guide RNA comprising the guide sequence, and a direct repeat sequence. In any such compositions, the delivery system may comprise a yeast system, a lipofection system, a microinjection system, a biolistic system, virosomes, liposomes, immunoliposomes, polycations, lipid:nucleic acid conjugates or artificial virions, or any other system as described herein. In particular embodiments, the delivery is via a particle, a nanoparticle, a lipid or a cell penetrating peptide (CPP).

In any such compositions, the composition may comprise more than one guide RNA, and each guide RNA has a different target whereby there is multiplexing. In any such systems comprising regulatory elements, at least one of said regulatory elements may comprise a tissue-specific promoter. The tissue-specific promoter may direct expression in a mammalian blood cell, in a mammalian liver cell or in a mammalian eye. In any of the above-described compositions or systems the direct repeat sequence, may comprise one or more protein-interacting RNA aptamers. The one or more aptamers may be located in the tetraloop. The one or more aptamers may be capable of binding MS2 bacteriophage coat protein.

In particular embodiments, the methods provided herein are methods of modifying a locus of interest in a cell comprising contacting the cell with any of the herein-described Cas effector proteins. Any such method may be ex vivo or in vivo.

The invention thus provides a method of treating a disease, disorder or infection in an individual in need thereof comprising identifying suitable treatment conditions and administering an effective amount of the compositions, systems or CRISPR-Cas complexes described herein. The disease, disorder or infection may comprise a viral infection. The viral infection may be HBV. The methods may also be methods for gene or genome editing.

Gene Editing for Altering a Target Loci

In an embodiment, the template nucleic acid alters the structure of the target position by participating in homologous recombination. In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include sequence that corresponds to a site on the target sequence that is cleaved by an Cas mediated cleavage event. In an embodiment, the template nucleic acid may include sequence that corresponds to both, a first site on the target sequence that is cleaved in a first Cas mediated event, and a second site on the target sequence that is cleaved in a second Cas mediated event.

In certain embodiments, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a target gene may be used to alter the structure of a target sequence. The template sequence may be used to alter an unwanted structure, e.g., an unwanted or mutant nucleotide. The template nucleic acid may include sequence which, when integrated, results in: decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

The template nucleic acid may include sequence which results in: a change in sequence of 1, 2, 3, 4, 5, 6, 7, 8, 9, 10, 11, 12 or more nucleotides of the target sequence. In an embodiment, the template nucleic acid may be 20+/−10, 30+/−10, 40+/−10, 50+/−10, 60+/−10, 70+/−10, 80+/−10, 90+/−10, 100+/−10, 1 10+/−10, 120+/−10, 130+/−10, 140+/−10, 150+/−10, 160+/−10, 170+/−10, 1 80+/−10, 190+/−10, 200+/−10, 210+/−10, or 220+/−10 nucleotides in length. In an embodiment, the template nucleic acid may be 30+/−20, 40+/−20, 50+/−20, 60+/−20, 70+/−20, 80+/−20, 90+/−20, 100+/−20, 1 10+/−20, 120+/−20, 130+/−20, 140+/−20, 150+/−20, 160+/−20, 170+/−20, 180+/−20, 190+/−20, 200+/−20, 210+/−20, or 220+/−20 nucleotides in length. In an embodiment, the template nucleic acid is 10 to 1,000, 20 to 900, 30 to 800, 40 to 700, 50 to 600, 50 to 500, 50 to 400, 50 to 300, 50 to 200, or 50 to 100 nucleotides in length.

A template nucleic acid comprises the following components: [5' homology arm]-[replacement sequence]-[3' homology arm]. The homology arms provide for recombination into the chromosome, thus replacing the undesired element, e.g., a mutation or signature, with the replacement sequence. In an embodiment, the homology arms flank the most distal cleavage sites. In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, or 2000 nucleotides 5' from the 5' end of the replacement sequence. In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, or 2000 nucleotides 3' from the 3' end of the replacement sequence.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In certain embodiments, template nucleic acids for correcting a mutation may designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

Promotion of Non-Homologous End-Joining

In certain embodiments, nuclease-induced non-homologous end-joining (NHEJ) can be used to target gene-specific knockouts. Nuclease-induced NHEJ can also be used to remove (e.g., delete) sequence in a gene of interest. Generally, NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein. The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily be greater than 50 bp, e.g., they can easily reach greater than about 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it may also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double-strand-cleaving Cas molecules and single strand, or nickase, Cas molecules can be used in the methods and compositions described herein to generate NHEJ-mediated indels. NHEJ-mediated indels targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

In an embodiment, in which a guide RNA and Cas nuclease generate a double strand break for the purpose of inducing NHEJ-mediated indels, a guide RNA may be configured to position one double-strand break in close proximity to a nucleotide of the target position. In an embodiment, the cleavage site may be between 0-500 bp away from the target position (e.g., less than 500, 400, 300, 200, 100, 50, 40, 30, 25, 20, 15, 10, 9, 8, 7, 6, 5, 4, 3, 2 or 1 bp from the target position).

In an embodiment, in which two guide RNAs complexing with Cas nickases induce two single strand breaks for the purpose of inducing NHEJ-mediated indels, two guide RNAs may be configured to position two single-strand breaks to provide for NHEJ repair a nucleotide of the target position.

Crispr Effector Protein Complexes can Deliver Functional Effectors

Unlike CRISPR-Cas-mediated gene knockout, which permanently eliminates expression by mutating the gene at the DNA level, CRISPR-Cas knockdown allows for temporary reduction of gene expression through the use of artificial transcription factors. Mutating key residues in both DNA cleavage domains of the Cas protein, such as FnCpf1 protein (e.g. the D917A and H1006A mutations of the FnCpf1 protein or D908A, E993A, D1263A according to AsCpf1 protein or D832A, E925A, D947A or D 1180A according to LbCpf1 protein) results in the generation of a catalytically inactive Cas. A catalytically inactive Cpf1 complexes with a guide RNA and localizes to the DNA sequence specified by that guide RNA's targeting domain, however, it does not cleave the target DNA. Fusion of the inactive Cpf1 protein, such as FnCpf1 protein (e.g. the D917A and H1006A mutations) to an effector domain, e.g., a transcription repression domain, enables recruitment of the effector to any DNA site specified by the guide RNA. In certain embodiments, Cas may be fused to a transcriptional repression domain and recruited to the promoter region of a gene. Especially for gene repression, it is contemplated herein that blocking the binding site of an endogenous transcription factor would aid in downregulating gene expression. In another embodiment, an inactive Cas can be fused to a chromatin modifying protein. Altering chromatin status can result in decreased expression of the target gene.

In an embodiment, a guide RNA molecule can be targeted to known transcription response elements (e.g., promoters, enhancers, etc.), known upstream activating sequences, and/or sequences of unknown or known function that are suspected of being able to control expression of the target DNA.

In some methods, a target polynucleotide can be inactivated to affect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In certain embodiments, the CRISPR enzyme comprises one or more mutations selected from the group consisting of D917A, E1006A and D1225A and/or the one or more mutations is in a RuvC domain of the CRISPR enzyme or is a mutation as otherwise as discussed herein. In some embodiments, the CRISPR enzyme has one or more mutations in a catalytic domain, wherein when transcribed, the direct repeat sequence forms a single stem loop and the guide sequence directs sequence-specific binding of a CRISPR complex to the target sequence, and wherein the enzyme further comprises a functional domain. In some embodiments, the functional domain is a transcriptional activation domain, preferably VP64. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain.

Use of Inactivated CRISPR Cas Enzyme for Detection Methods Such as FISH

In one aspect, the invention provides an engineered, non-naturally occurring CRISPR-Cas system comprising a catalytically inactivate Cas protein described herein, preferably an inactivate Cas (dCas), and use this system in detection methods such as fluorescence in situ hybridization (FISH). dCas which lacks the ability to produce DNA double-strand breaks may be fused with a marker, such as fluorescent protein, such as the enhanced green fluorescent protein (eEGFP) and co-expressed with small guide RNAs to target pericentric, centric and teleomeric repeats in vivo. The dCas system can be used to visualize both repetitive sequences and individual genes in the human genome. Such new applications of labelled dCas CRISPR-cas systems may be important in imaging cells and studying the functional nuclear architecture, especially in cases with a small nucleus volume or complex 3-D structures. (Chen B, Gilbert L A, Cimini B A, Schnitzbauer J, Zhang W, Li G W, Park J, Blackburn E H, Weissman J S, Qi LS, Huang B. 2013. Dynamic imaging of genomic loci in living human cells by an optimized CRISPR/Cas system. Cell 155(7):1479-91. doi: 10.1016/j.cell.2013.12.001.) Nucleic acids, amino acids and proteins, Regulatory sequences, Vectors, etc.

The invention uses nucleic acids to bind target DNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25º C. lower than the thermal melting point (Tm). The Tm is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15º C. lower than the Tm. In order to require at least about 70% nucleotide complementarity of hybridized sequences, moderately-stringent washing conditions are selected to be about 15 to 30º C. lower than the Tm. Highly permissive (very low stringency) washing conditions may be as low as 50º C. below the Tm, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42º C., or incubation in 5×SSC and 1% SDS at 65º C., with wash in 0.2×SSC and 0.1% SDS at 65º C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p387). Examples of other software than may perform sequence comparisons include, but are not limited to, the BLAST package (see Ausubel et al., 1999 Short Protocols in Molecular Biology, 4th Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174 (2): 247-50; FEMS Microbiol Lett. 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" Comput. Appl. Biosci. 9: 745-756) (Taylor W. R. (1986) "The classification of amino acid conservation" J. Theor. Biol. 119; 205-218). Conservative substitutions may be made, for example according to the table below which describes a generally accepted Venn diagram grouping of amino acids.

TABLE 11

| Set | | Sub-set | |
|---|---|---|---|
| Hydrophobic | F W Y H K M I L V A G C (SEQ ID NO: 202) | Aromatic | F W Y H (SEQ ID NO: 205) |
| | | Aliphatic | I L V |
| Polar | W Y H K R E D C S T N Q (SEQ ID NO: 203) | Charged | H K R E D (SEQ ID NO: 206) |
| | | Positively charged | H K R |
| | | Negatively charged | E D |
| Small | V C A G S P T N D (SEQ ID NO: 204) | Tiny | A G S |

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)).

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., PNAS (1992) 89(20), 9367-9371 and Horwell D C, Trends Biotechnol. (1995) 13(4), 132-134.

Homology modelling: Corresponding residues in other Cas orthologs can be identified by the methods of Zhang et al., 2012 (Nature; 490(7421): 556-60) and Chen et al., 2015 (PLoS Comput Biol; 11(5): e1004248)-a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR.

Functional Domains

In some embodiments, one or more functional domains are associated with the Cas effector protein. In some embodiments, one or more functional domains are associated with an adaptor protein, for example as used with the modified guides of Konnerman et al. (Nature 517, 583-588, 29 Jan. 2015). In some embodiments, one or more functional domains are associated with a dead gRNA (dRNA). In some embodiments, a dRNA complex with active Cas effector protein directs gene regulation by a functional domain at on gene locus while an gRNA directs DNA cleavage by the active Cas effector protein at another locus, for example as described analogously in CRISPR-Cas9 systems by Dahlman et al., 'Orthogonal gene control with a catalytically active Cas9 nuclease' (in press). In some embodiments, dRNAs are selected to maximize selectivity of regulation for a gene locus of interest compared to off-target regulation. In some embodiments, dRNAs are selected to maximize target gene regulation and minimize target cleavage.

For the purposes of the following discussion, reference to a functional domain could be a functional domain associated with the Cas effector protein or a functional domain associated with the adaptor protein.

In the practice of the invention, loops of the gRNA may be extended, without colliding with the Cas protein by the insertion of distinct RNA loop(s) or distinct sequence(s) that may recruit adaptor proteins that can bind to the distinct RNA loop(s) or distinct sequence(s). The adaptor proteins may include but are not limited to orthogonal RNA-binding protein/aptamer combinations that exist within the diversity of bacteriophage coat proteins, including those described in this application. In some embodiments, the one or more functional domains is an NLS (Nuclear Localization Sequence) or an NES (Nuclear Export Signal). In some embodiments, the one or more functional domains is a transcriptional activation domain comprises VP64, p65, MyoD1, HSF1, RTA, SET7/9 and a histone acetyltransferase. Other references herein to activation (or activator) domains in respect of those associated with the CRISPR enzyme include any known transcriptional activation domain and specifically VP64, p65, MyoD1, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NuE domain, NcoR domain, SID domain or a SID4X domain.

In some embodiments, the one or more functional domains have one or more activities comprising methylase activity, demethylase activity, transcription activation activity, transcription repression activity, transcription release factor activity, histone modification activity, RNA cleavage activity, DNA cleavage activity, DNA integration activity or nucleic acid binding activity.

Histone modifying domains are also preferred in some embodiments. Exemplary histone modifying domains are discussed below. Transposase domains, HR (Homologous Recombination) machinery domains, recombinase domains, and/or integrase domains are also preferred as the present functional domains. In some embodiments, DNA integration activity includes HR machinery domains, integrase domains, recombinase domains and/or transposase domains. Histone acetyltransferases are preferred in some embodiments.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some embodiments, the one or more functional domains is attached to the Cas effector protein so that upon binding to the sgRNA and target the functional domain is in a spatial orientation allowing for the functional domain to function in its attributed function.

In some embodiments, the one or more functional domains is attached to the adaptor protein so that upon binding of the Cas effector protein to the gRNA and target, the functional domain is in a spatial orientation allowing for the functional domain to function in its attributed function.

In an aspect the invention provides a composition as herein discussed wherein the one or more functional domains is attached to the Cas effector protein or adaptor protein via a linker, optionally a GlySer linker, as discussed herein.

Endogenous transcriptional repression is often mediated by chromatin modifying enzymes such as histone methyltransferases (HMTs) and deacetylases (HDACs). Repressive histone effector domains are known and an exemplary list is provided below. In the exemplary table, preference was given to proteins and functional truncations of small size to facilitate efficient viral packaging (for instance via AAV). In general, however, the domains may include HDACs, histone methyltransferases (HMTs), and histone acetyltransferase (HAT) inhibitors, as well as HDAC and HMT recruiting proteins. The functional domain may be or include, in some embodiments, HDAC Effector Domains, HDAC Recruiter Effector Domains, Histone Methyltransferase (HMT) Effector Domains, Histone Methyltransferase (HMT) Recruiter Effector Domains, or Histone Acetyltransferase Inhibitor Effector Domains.

TABLE 12

HDAC Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| HDAC I | HDAC8 | — | — | V. laevis | 325 | 1-325 | 325 | 1-272: HDAC |
| HDAC I | RPD3 | — | — | S. cerevisiae | 433 | 19-340 | 322 (Vannier) | 19-331: HDAC |
| HDAC IV | MesoLo4 | — | — | M. loti | 300 | 1-300 (Gregoretti) | 300 | — |
| HDAC IV | HDAC11 | — | — | H. sapiens | 347 | 1-347 (Gao) | 347 | 14-326: HDAC |
| HD2 | HDT1 | — | — | A. thaliana | 245 | 1-211 (Wu) | 211 | — |
| SIRT I | SIRT3 | H3K9Ac H4K16Ac H3K56Ac | — | H. sapiens | 399 | 143-399 (Scher) | 257 | 126-382: SIRT |
| SIRT I | HST2 | — | — | C. albicans | 331 | 1-331 (Hnisz) | 331 | — |
| SIRT I | CobB | — | — | E. coli (K12) | 242 | 1-242 (Landry) | 242 | — |
| SIRT I | HST2 | — | — | S. cerevisiae | 357 | 8-298 (Wilson) | 291 | — |
| SIRT III | SIRT5 | H4K8Ac H4K16Ac | — | H. sapiens | 310 | 37-310 (Gertz) | 274 | 41-309: SIRT |
| SIRT III | Sir2A | — | — | P. falciparum | 273 | 1-273 (Zhu) | 273 | 19-273: SIRT |
| SIRT IV | SIRT6 | H3K9Ac H3K56Ac | — | H. sapiens | 355 | 1-289 (Tennen) | 289 | 35-274: SIRT |

Accordingly, the repressor domains of the present invention may be selected from histone methyltransferases (HMTs), histone deacetylases (HIDACs), histone acetyltransferase (HAT) inhibitors, as well as HIDAC and HMNT recruiting proteins.

The HIDAC domain may be any of those in the table above, namely: HIDAC8, RPD3, MesoLo4, HIDAC1 1, HIDT1, SIRT3, HST2, CobB, HST2, SIRT5, Sir2A, or SIRT6.

In some embodiment, the functional domain may be a HIDAC Recruiter Effector Domain. Preferred examples include those in Table 13 below, namely MeCP2, MBD2b, Sin3a, NcoR, SALLi, RCOR1. NcoR is exemplified in the present Examples and, although preferred, it is envisaged that others in the class will also be useful.

TABLE 13

HDAC Recruiter Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| Sin3a | MeCP2 | — | — | R. norvegicus | 492 | 207-492 (Nan) | 286 | — |
| Sin3a | MBD2b | — | — | H. sapiens | 262 | 45-262 (Boeke) | 218 | — |
| Sin3a | Sin3a | — | — | H. sapiens | 1273 | 524-851 (Laherty) | 328 | 627-829: HDAC1 interaction |
| NcoR | NcoR | — | — | H. sapiens | 2440 | 420-488 (Zhang) | 69 | — |
| NuRD | SALL1 | — | — | M. musculus | 1322 | 1-93 (Lauberth) | 93 | — |
| CoREST | RCOR1 | — | — | H. sapiens | 482 | 81-300 (Gu, Ouyang) | 220 | — |

In some embodiment, the functional domain may be a Methyltransferase (TBMT) Effector Domain. Preferred examples include those in Table 14 below, namely NUJE, vSET, ETIMT2/G9A, SUV39H1, dim-5, KYP, SUVR4, SET4, SETi, SETD8, and TgSET8. NUE is exemplified in the present Examples and, although preferred, it is envisaged that others in the class will also be useful.

TABLE 14

Histone Methyltransferase (HMT) Effector Domains

| Subtype/ Complex | Name | Substrate (if known) | Modification (if known) | Organism | Full size (aa) | Selected truncation (aa) | Final size (aa) | Catalytic domain |
|---|---|---|---|---|---|---|---|---|
| SET | NUE | H2B, H3, H4 | — | C. trachomatis | 219 | 1-219 (Pennini) | 219 | — |
| SET | vSET | — | H3K27me3 | P. bursaria chlorella virus | 119 | 1-119 (Mujtaba) | 119 | 4-112: SET2 |
| SUV39 family | EHMT2/ G9A | H1.4K2, H3K9, H3K27 | H3K9me1/2 HlK25me1 | M. musculus | 1263 | 969-1263 (Tachibana) | 295 | 1025-1233: preSET, SET, postSET |
| SUV39 | SUV39 H1 | — | H3K9me2/3 | H. sapiens | 412 | 79-412 (Snowden) | 334 | 172-412: preSET, SET, postSET |
| Suvar3-9 | dim-5 | — | H3K9me3 | N. crassa | 331 | 1-331 (Rathert) | 331 | 77-331: preSET, SET, postSET |
| Suvar3-9 (SUVH subfamily) | KYP | — | H3K9me1/2 | A. thaliana | 624 | 335-601 | 267 (Jackson) | — |
| Suvar3-9 (SUVR subfamily) | SUVR4 | H3K9me1 | H3K9me2/3 | A. thaliana | 492 | 180-492 | 313 (Thorstensen) | 192-462: preSET, SET, postSET |
| Suvar4-20 | SET4 | — | H4K20me3 | C. elegans | 288 | 1-288 (Vielle) | 288 | — |
| SET8 | SET1 | — | H4K20me1 | C. elegans | 242 | 1-242 (Vielle) | 242 | — |
| SET8 | SETD8 | — | H4K20me1 | H. sapiens | 393 | 185-393 (Couture) | 209 | 256-382: SET |
| SET8 | TgSET8 | — | H4K20me1/ 2/3 | T. gondii | 1893 | 1590-1893 (Sautel) | 304 | 1749-1884: SET |

In some embodiment, the functional domain may be a Histone Methyltransferase (TBMT) Recruiter Effector Domain. Preferred examples include those in Table 15 below, namely Hp1a, PIHIF 19, and NTPP 1.

TABLE 15

Histone Methyltransferase (HMT) Recruiter Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | Hp1a | — | H3K9me3 | M. musculus | 191 | 73-191 | 119 (Hathaway) | 121-179: chromoshadow |
| — | PHF19 | — | H3K27me3 | H. sapiens | 580 | (1-250) + GGSG linker + (500-580) | 335 (Ballare) | 163-250: PHD2 |
| — | NIPP1 | — | H3K27me3 | H. sapiens | 351 | 1-329 (Jin) | 329 | 310-329: EED |

In some embodiment, the functional domain may be Histone Acetyltransferase Inhibitor Effector Domain. Preferred examples include SET/TAF-1β listed in the Table below.

TABLE 16

Histone Acetyltransferase Inhibitor Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | SET/TAF-1β | — | — | M. musculus | 289 | 1-289 (Cervoni) | 289 | — |

It is also preferred to target endogenous (regulatory) control elements (such as enhancers and silencers) in addition to a promoter or promoter-proximal elements. Thus, the invention can also be used to target endogenous control elements (including enhancers and silencers) in addition to targeting of the promoter. These control elements can be located upstream and downstream of the transcriptional start site (TSS), starting from 200 bp from the TSS to 100 kb away. Targeting of known control elements can be used to activate or repress the gene of interest. In some cases, a single control element can influence the transcription of multiple target genes. Targeting of a single control element could therefore be used to control the transcription of multiple genes simultaneously.

Targeting of putative control elements on the other hand (e.g. by tiling the region of the putative control element as well as 200 bp up to 100 kB around the element) can be used as a means to verify such elements (by measuring the transcription of the gene of interest) or to detect novel control elements (e.g. by tiling 100 kb upstream and downstream of the TSS of the gene of interest). In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Use of a functional domain linked to a Cas effector protein as described herein, preferably a dead-Cas effector protein, more preferably a dead-FnCpf1 effector protein, to target epigenomic sequences can be used to activate or repress promoters, silencer or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6th April 2015).

In some preferred embodiments, the functional domain is linked to a dead-Cas effector protein to target and activate epigenomic sequences such as promoters or enhancers. One or more guides directed to such promoters or enhancers may also be provided to direct the binding of the CRISPR enzyme to such promoters or enhancers.

The term "associated with" is used here in relation to the association of the functional domain to the Cas effector protein or the adaptor protein. It is used in respect of how one molecule 'associates' with respect to another, for example between an adaptor protein and a functional domain, or between the Cas effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the Cas effector protein or adaptor protein is associated with a functional domain by binding thereto. In other embodiments, the Cas effector protein or adaptor protein is associated with a functional domain because the two are fused together, optionally via an intermediate linker.

Attachment of a functional domain or fusion protein can be via a linker, e.g., a flexible glycine-serine (GlyGlyGly-Ser) (SEQ ID NO: 207) or (GGGS)3 (SEQ ID NO: 208) or a rigid alpha-helical linker such as (Ala(GluAlaAlaAlaLys)Ala) (SEQ ID NO: 209). Linkers such as (GGGGS)3 (SEQ ID NO: 198) are preferably used herein to separate protein or peptide domains. (GGGGS)3 (SEQ ID NO: 198) is preferable because it is a relatively long linker (15 amino acids). The glycine residues are the most flexible and the serine residues enhance the chance that the linker is on the outside of the protein. $(GGGGS)_6$ (SEQ ID NO: 199) $(GGGGS)_9$ (SEQ ID NO: 200) or $(GGGGS)_{12}$ (SEQ ID NO: 201) may preferably be used as alternatives. Other preferred alternatives are $(GGGGS)_1$ (SEQ ID NO: 210), $(GGGGS)_2$ SEQ ID NO: 211), $(GGGGS)_4$ SEQ ID NO: 212), $(GGGGS)_5$ SEQ ID NO: 213), $(GGGGS)_7$ SEQ ID NO: 214), $(GGGGS)_5$ SEQ ID NO: 215), $(GGGGS)_{10}$ SEQ ID NO: 216), or $(GGGGS)_1$ SEQ ID NO: 217). Alternative linkers are available, but highly flexible linkers are thought to work best to allow for maximum opportunity for the 2 parts of the Cas to come together and thus reconstitute Cas activity. One alternative is that the NLS of nucleoplasmin can be used as a linker. For example, a linker can also be used between the Cas and any functional domain. Again, a $(GGGGS)_3$ (SEQ ID NO: 198) linker may be used here (or the 6 (SEQ ID NO: 199), 9 (SEQ ID NO: 200), or 12 (SEQ ID NO: 201) repeat versions therefore) or the NLS of nucleoplasmin can be used as a linker between Cas and the functional domain.

General Comments on Methods of Use of the Crispr System

In particular embodiments, the methods described herein may involve targeting one or more polynucleotide targets of interest. The polynucleotide targets of interest may be targets which are relevant to a specific disease or the treatment thereof, relevant for the generation of a given trait of interest or relevant for the production of a molecule of interest. When referring to the targeting of a "polynucleotide target" this may include targeting one or more of a coding regions, an intron, a promoter and any other 5' or 3' regulatory regions such as termination regions, ribosome binding sites, enhancers, silencers etc. The gene may encode any protein or RNA of interest. Accordingly, the target may be a coding region which can be transcribed into mRNA, tRNA or rRNA, but also recognition sites for proteins involved in replication, transcription and regulation thereof.

In particular embodiments, the methods described herein may involve targeting one or more genes of interest, wherein at least one gene of interest encodes a long noncoding RNA (lncRNA). While lncRNAs have been found to be critical for cellular functioning. As the lncRNAs that are essential have been found to differ for each cell type (C. P. Fulco et al., 2016, Science, doi:10.1126/science.aag2445; N. E. Sanjana et al., 2016, Science, doi:10.1126/science.aaf8325), the methods provided herein may involve the step of determining the lncRNA that is relevant for cellular function for the cell of interest.

In an exemplary method for modifying a target polynucleotide by integrating an exogenous polynucleotide template, a double stranded break is introduced into the genome sequence by the CRISPR complex, the break is repaired via homologous recombination an exogenous polynucleotide template such that the template is integrated into the genome. The presence of a double-stranded break facilitates integration of the template.

In other embodiments, this invention provides a method of modifying expression of a polynucleotide in a eukaryotic cell. The method comprises increasing or decreasing expression of a target polynucleotide by using a CRISPR complex that binds to the polynucleotide.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In some methods, a control sequence can be inactivated such that it no longer functions as a control sequence. As used herein, "control sequence" refers to any nucleic acid sequence that effects the transcription, translation, or accessibility of a nucleic acid sequence. Examples of a control sequence include, a promoter, a transcription terminator, and an enhancer are control sequences. The inactivated target sequence may include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). In some methods, the inactivation of a target sequence results in "knockout" of the target sequence.

Also provided herein are methods of functional genomics which involve identifying cellular interactions by introducing multiple combinatorial perturbations and correlating observed genomic, genetic, proteomic, epigenetic and/or phenotypic effects with the perturbation detected in single cells, also referred to as "perturb-seq". In one embodiment, these methods combine single-cell RNA sequencing (RNA-seq) and clustered regularly interspaced short palindromic repeats (CRISPR)-based perturbations (Dixit et al. 2016, Cell 167, 1853-1866; Adamson et al. 2016, Cell 167, 1867-1882). Generally, these methods involve introducing a number of combinatorial perturbations to a plurality of cells in a population of cells, wherein each cell in the plurality of the cells receives at least 1 perturbation, detecting genomic, genetic, proteomic, epigenetic and/or phenotypic differences in single cells compared to one or more cells that did not receive any perturbation, and detecting the perturbation(s) in single cells; and determining measured differences relevant to the perturbations by applying a model accounting for co-variates to the measured differences, whereby intercellular and/or intracellular networks or circuits are inferred. More particularly, the single cell sequencing comprises cell barcodes, whereby the cell-of-origin of each RNA is recorded. More particularly, the single cell sequencing comprises unique molecular identifiers (UMI), whereby the capture rate of the measured signals, such as transcript copy number or probe binding events, in a single cell is determined.

These methods can be used for combinatorial probing of cellular circuits, for dissecting cellular circuitry, for delineating molecular pathways, and/or for identifying relevant targets for therapeutics development. More particularly, these methods may be used to identify groups of cells based on their molecular profiling. Similarities in gene-expression profiles between organic (e.g. disease) and induced (e.g. by small molecule) states may identify clinically-effective therapies.

Accordingly, in particular embodiments, therapeutic methods provided herein comprise, determining, for a population of cells isolated from a subject, optimal therapeutic target and/or therapeutic, using perturb-seq as described above.

In particular embodiments, pertub-seq methods as referred to herein elsewhere are used to determine, in an isolated cell or cell line, cellular circuits which may affect production of a molecule of interest.

Additional CRISPR-Cas Development and Use Considerations

The present invention may be further illustrated and extended based on aspects of CRISPR-Cas9 development and use as set forth in the following articles and particularly as relates to delivery of a CRISPR protein complex and uses of an RNA guided endonuclease in cells and organisms:

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15;339(6121): 819-23 (2013);

RNA-guided editing of bacterial genomes using CRISPR-Cas systems. Jiang W., Bikard D., Cox D., Zhang F, Marraffini L A. Nat Biotechnol March;31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9;153(4):910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22;500(7463):472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

Genome engineering using the CRISPR-Cas9 system. Ran, F A., Hsu, P D., Wright, J., Agarwala, V., Scott, D A., Zhang, F. Nature Protocols November;8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science Decemeber 12. (2013). [Epub ahead of print];

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. June 5;157(6):1262-78 (2014).

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December;32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January;33(1):102-6 (2015);

Genome-scale transcriptional activation by an engineered CRISPR-Cas9 complex, Konermann S, Brigham M D, Trevino A E, Joung J, Abudayyeh OO, Barcena C, Hsu P D, Habib N, Gootenberg J S, Nishimasu H, Nureki O, Zhang F., Nature. January 29;517(7536):583-8 (2015).

A split-Cas9 architecture for inducible genome editing and transcription modulation, Zetsche B, Volz S E, Zhang F., (published online 2 Feb. 2015) Nat Biotechnol. February;33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9;520 (7546):186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015)

Nishimasu et al., Crystal Structure of *Staphylococcus aureus* Cas9," Cell 162, 1113-1126 (Aug. 27, 2015)

BCL11A enhancer dissection by Cas9-mediated in situ saturating mutagenesis, Canver et al., Nature 527

(7577):192-7 (Nov. 12, 2015) doi: 10.1038/nature15521. Epub 2015 September 16.

*Cpf1 Is a Single RNA-Guided Endonuclease of a Class 2 CRISPR-Cas System,* Zetsche et al., Cell 163, 759-71 (Sep. 25, 2015).

*Discovery and Functional Characterization of Diverse Class 2 CRISPR-Cas Systems,* Shmakov et al., Molecular Cell, 60(3), 385-397 doi: 10.1016/j.molcel.2015.10.008 Epub Oct. 22, 2015.

*Rationally engineered Cas9 nucleases with improved specificity,* Slaymaker et al., Science 2016 Jan. 1 351 (6268): 84-88 doi: 10.1126/science.aad5227. Epub 2015 Dec. 1. [Epub ahead of print].

Gao et al, "Engineered Cpf1 Enzymes with Altered PAM Specificities," bioRxiv 091611; doi: dx.doi.org/10.1101/091611 (Dec. 4, 2016) each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also Streptococcuspyogenes Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR-Cas system for the one-step generation of mice carrying mutations in multiple genes which were traditionally generated in multiple steps by sequential recombination in embryonic stem cells and/or time-consuming intercrossing of mice with a single mutation. The CRISPR-Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and gRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Canver et al. (2015) demonstrated a CRISPR-Cas9-based functional investigation of non-coding genomic elements. The authors we developed pooled CRISPR-Cas9 guide RNA libraries to perform in situ saturating mutagenesis of the human and mouse BCL11A enhancers which revealed critical features of the enhancers.

Zetsche et al. (2015) reported characterization of Cpf1, a class 2 CRISPR nuclease from *Francisella novicida* U112 having features distinct from Cas9. Cpf1 is a single RNA-guided endonuclease lacking tracrRNA, utilizes a T-rich protospacer-adjacent motif, and cleaves DNA via a staggered DNA double-stranded break.

Shmakov et al. (2015) reported three distinct Class 2 CRISPR-Cas systems. Two system CRISPR enzymes (C2c1 and C2c3) contain RuvC-like endonuclease domains distantly related to Cpf1. Unlike Cpf1, C2c1 depends on both crRNA and tracrRNA for DNA cleavage. The third enzyme (C2c2) contains two predicted HEPN RNase domains and is tracrRNA independent.

Slaymaker et al (2016) reported the use of structure-guided protein engineering to improve the specificity of *Streptococcus pyogenes* Cas9 (SpCas9). The authors developed "enhanced specificity" SpCas9 (eSpCas9) variants which maintained robust on-target cleavage with reduced off-target effects.

The methods and tools provided herein are exemplified for Cas. Orthologs of Cas have been identified in different bacterial species as described herein. Further type II nucleases with similar properties can be identified using methods described in the art (Shmakov et al. 2015, 60:385-397; Abudayeh et al. 2016, Science, 5;353(6299)). In particular embodiments, such methods for identifying novel CRISPR effector proteins may comprise the steps of selecting sequences from the database encoding a seed which identifies the presence of a CRISPR Cas locus, identifying loci located within 10 kb of the seed comprising Open Reading Frames (ORFs) in the selected sequences, selecting therefrom loci comprising ORFs of which only a single ORF encodes a novel CRISPR effector having greater than 700 amino acids and no more than 90% homology to a known CRISPR effector. In particular embodiments, the seed is a protein that is common to the CRISPR-Cas system, such as Cas1. In further embodiments, the CRISPR array is used as a seed to identify new effector proteins.

The effectiveness of the present invention has been demonstrated. Preassembled recombinant CRISPR-Cas complexes comprising Cas and crRNA may be transfected, for example by electroporation, resulting in high mutation rates and absence of detectable off-target mutations. Hur, J. K. et al, Targeted mutagenesis in mice by electroporation of Cas ribonucleoproteins, Nat Biotechnol. 2016 Jun. 6. doi: 10.1038/nbt.3596. Genome-wide analyses shows that Cas is highly specific. By one measure, in vitro cleavage sites determined for SpCas9 in human HEK293T cells were significantly fewer that for SpCas9. Kim, D. et al., Genome-wide analysis reveals specificities of Cas endonucleases in human cells, Nat Biotechnol. 2016 Jun. 6. doi: 10.1038/nbt.3609. [An efficient multiplexed system employing Cas has been demonstrated in *Drosophila* employing gRNAs processed from an array containing inventing tRNAs. Port, F. et al, Expansion of the CRISPR toolbox in an animal with tRNA-flanked Cas9 and Cas gRNAs. doi: dx.doi.org/10.1101/046417.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,697,359, 8,771,945, 8,795,965, 8,865,406, 8,871,445, 8,889,356, 8,889,418, 8,895,308, 8,906,616, 8,932,814, 8,945,839, 8,993,233 and 8,999,641; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); US 2015-0184139 (U.S. application Ser. Nos. 14/324,960); 14/054,414 European Patent Applications EP 2 771 468 (EP13818570.7), EP 2 764 103 (EP13824232.6), and EP 2 784 162 (EP14170383.5); and PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809), WO 2015/089351 (PCT/US2014/069897), WO 2015/089354 (PCT/US2014/069902), WO 2015/089364 (PCT/US2014/069925), WO 2015/089427 (PCT/US2014/070068), WO 2015/089462 (PCT/US2014/070127), WO 2015/089419 (PCT/US2014/070057), WO 2015/089465 (PCT/US2014/070135), WO 2015/089486 (PCT/US2014/070175), PCT/US2015/051691, PCT/US2015/051830. Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/835,973, 61/836,080, 61/836,101, and 61/836,127, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT/US2014/62558 filed Oct. 28, 2014, and U.S. Provisional Patent Applications Ser. Nos. 61/915,148, 61/915,150, 61/915,153, 61/915,203, 61/915,251, 61/915,301, 61/915,267, 61/915,260, and 61/915,397, each filed Dec. 12, 2013; 61/757,972 and 61/768,959, filed on Jan. 29, 2013 and Feb. 25, 2013; 62/010,888 and 62/010,879, both filed Jun. 11, 2014; 62/010,329, 62/010,439 and 62/010,441, each filed Jun. 10, 2014; 61/939,228 and 61/939,242, each filed Feb. 12, 2014; 61/980,012, filed April 15,2014; 62/038,358, filed Aug. 17, 2014; 62/055,484, 62/055,460 and 62/055,487, each filed Sep. 25, 2014; and 62/069,243, filed Oct. 27, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to PCT application designating, inter alia, the United States, application No. PCT/US14/41806, filed Jun. 10, 2014.

Mention is also made of U.S. application 62/180,709, 17-June-15, PROTECTED GUIDE RNAS (PGRNAS); U.S. application 62/091,455, filed, 12-December-14, PROTECTED GUIDE RNAS (PGRNAS); U.S. application 62/096,708, 24-December-14, PROTECTED GUIDE RNAS (PGRNAS); U.S. applications 62/091,462, 12-December-14, 62/096,324, 23-December-14, 62/180,681, 17 Jun. 2015, and 62/237,496, 5 Oct. 2015, DEAD GUIDES FOR CRISPR TRANSCRIPTION FACTORS; U.S. application 62/091,456, 12-December-14 and 62/180,692, 17 Jun. 2015, ESCORTED AND FUNCTIONALIZED GUIDES FOR CRISPR-CAS SYSTEMS; U.S. application 62/091,461, 12-December-14, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19-December-14, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24-December-14, ENGINEERING OF SYSTEMS, METHODS AND OPTIMIZED ENZYME AND GUIDE SCAFFOLDS FOR SEQUENCE MANIPULATION; U.S. application 62/098,059, 30-December-14, 62/181,641, 18 Jun. 2015, and 62/181,667, 18 Jun. 2015, RNA-TARGETING SYSTEM; U.S. application 62/096, 656, 24-December-14 and 62/181,151, 17 Jun. 2015, CRISPR HAVING OR ASSOCIATED WITH DESTABILIZATION DOMAINS; U.S. application 62/096,697, 24-December-14, CRISPR HAVING OR ASSOCIATED WITH AAV; U.S. application 62/098,158, 30-December-14, ENGINEERED CRISPR COMPLEX INSERTIONAL TARGETING SYSTEMS; U.S. application 62/151,052, 22-April-15, CELLULAR TARGETING FOR EXTRACELLULAR EXOSOMAL REPORTING; U.S. application 62/054,490, 24-September-14, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 61/939,154, 12-F EB-14, SYSTEMS, METHODS AND COMPOSITIONS FOR SEQUENCE MANIPULATION WITH OPTIMIZED FUNCTIONAL CRISPR-CAS SYSTEMS; U.S. application 62/055,484, 25-September-14, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4-December-14, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24-September-14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23-October-14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. applications 62/054,675, 24-September-14 and 62/181,002, 17 Jun. 2015, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24-September-14, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25-September-14, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25-September-14, MULTIFUNCTIONAL-CRISPR COMPLEXES AND/OR OPTIMIZED ENZYME LINKED FUNCTIONAL-CRISPR COMPLEXES; U.S. application 62/087,475, 4-December-14 and 62/181,690, 18 Jun. 2015, FUNCTIONAL SCREENING WITH OPTIMIZED FUNCTIONAL CRISPR-CAS SYSTEMS; U.S. application 62/055,487, 25-September-14, FUNCTIONAL SCREENING WITH OPTIMIZED FUNCTIONAL CRISPR-CAS SYSTEMS; U.S. application 62/087,546, 4-December-14 and 62/181,687, 18 Jun. 2015, MULTIFUNCTIONAL CRISPR COMPLEXES AND/OR OPTIMIZED ENZYME LINKED FUNCTIONAL-CRISPR COMPLEXES; and U.S. application 62/098,285, 30-December-14, CRISPR MEDIATED IN VIVO MODELING AND GENETIC SCREENING OF TUMOR GROWTH AND METASTASIS.

Mention is made of U.S. applications 62/181,659, 18 Jun. 2015 and 62/207,318, 19 Aug. 2015, ENGINEERING AND OPTIMIZATION OF SYSTEMS, METHODS, ENZYME AND GUIDE SCAFFOLDS OF CAS9 ORTHOLOGS AND VARIANTS FOR SEQUENCE MANIPULATION.

Mention is made of U.S. applications 62/181,663, 18 Jun. 2015 and 62/245,264, 22 Oct. 2015, NOVEL CRISPR ENZYMES AND SYSTEMS, U.S. applications 62/181,675, 18 Jun. 2015, 62/285,349, 22 Oct. 2015, 62/296,522, 17 Feb. 2016, and 62/320,231, 8 Apr. 2016, NOVEL CRISPR ENZYMES AND SYSTEMS, U.S. application 62/232,067, 24 Sep. 2015, U.S. application Ser. No. 14/975,085, 18 Dec. 2015, European application No. 16150428.7, U.S. application 62/205,733, 16 Aug. 2015, U.S. application 62/201,542, 5 Aug. 2015, U.S. application 62/193,507, 16 Jul. 2015, and U.S. application 62/181,739, 18-June-2015, each entitled NOVEL CRISPR ENZYMES AND SYSTEMS and of U.S. application 62/245,270, 22 Oct. 2015, NOVEL CRISPR ENZYMES AND SYSTEMS. Mention is also made of U.S. application 61/939,256, 12 Feb. 2014, and WO 2015/089473 (PCT/US2014/070152), 12 Dec. 2014, each entitled ENGINEERING OF SYSTEMS, METHODS AND OPTIMIZED GUIDE COMPOSITIONS WITH NEW ARCHITECTURES FOR SEQUENCE MANIPULATION. Mention is also made of PCT/US2015/045504, 15 Aug. 2015, U.S. application 62/180,699, 17 Jun. 2015, and U.S. application 62/038,358, 17 Aug. 2014, each entitled GENOME EDITING USING CAS9 NICKASES.

In addition, mention is made of PCT application PCT/US14/70057, entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, and of PCT application PCT/US14/70127, entitled "DELIVERY, USE AND THERAPEUTIC APPLICATIONS OF THE CRISPR-CAS SYSTEMS AND COMPOSITIONS FOR GENOME EDITING "(claiming priority from one or more or all of US provisional patent applications: 61/915,176; 61/915,192; 61/915,215; 61/915,107, 61/915,145; 61/915,148; and 61/915,153 each filed Dec. 12, 2013) ("the Eye PCT"), incorporated herein by reference, with respect to a method of preparing an sgRNA-and-Cpf1 protein containing particle comprising admixing a mixture comprising an sgRNA and Cpf1 protein (and optionally HDR template) with a mixture comprising or consisting essentially of or consisting of surfactant, phospholipid, biodegradable polymer, lipoprotein and alcohol; and particles from such a process. For example, wherein Cpf1 protein and sgRNA were mixed together at a suitable, e.g., 3:1 to 1:3 or 2:1 to 1:2 or 1:1 molar ratio, at a suitable temperature, e.g., 15-30C, e.g., 20-25C, e.g., room temperature, for a suitable time, e.g., 15-45, such as 30 minutes, advantageously in sterile, nuclease free buffer, e.g., 1× PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a C1-6 alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cpf1 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP: DMPC: PEG: Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas protein and components that form a particle; as well as particles from such admixing. Aspects of the instant invention can involve particles; for example, particles using a process analogous to that of the Particle Delivery PCT or that of the Eye PCT, e.g., by admixing a mixture comprising sgRNA and/or Cas as in the instant invention and components that form a particle, e.g., as in the Particle Delivery PCT or in the Eye PCT, to form a particle and particles from such admixing (or, of course, other particles involving sgRNA and/or Cas as in the instant invention).

Base Editing

Cas proteins described herein, e.g., those with reduced immunogenicity, can be used in base editing. In general, the Cas proteins or a variant thereof (such as a dead or inactive Cas) may be associated with a deaminase, e.g., a adenosine or cytidine deaminase. In certain example embodiments, a dCas can be fused with a adenosine deaminase or cytidine deaminase for base editing purposes. Reference is made to PCT/US2018/039616, PCT/US2018/039618, PCT/US2018/052247, PCT/US2018/054469, PCT/US2018/0571179 and PCT/US2018/057177, incorporated herein by reference.

Adenosine Deaminase

The term "adenosine deaminase" or "adenosine deaminase protein" as used herein refers to a protein, a polypeptide, or one or more functional domain(s) of a protein or a polypeptide that is capable of catalyzing a hydrolytic deamination reaction that converts an adenine (or an adenine moiety of a molecule) to a hypoxanthine (or a hypoxanthine moiety of a molecule), as shown below. In some embodiments, the adenine-containing molecule is an adenosine (A), and the hypoxanthine-containing molecule is an inosine (I). The adenine-containing molecule can be deoxyribonucleic acid (DNA) or ribonucleic acid (RNA).

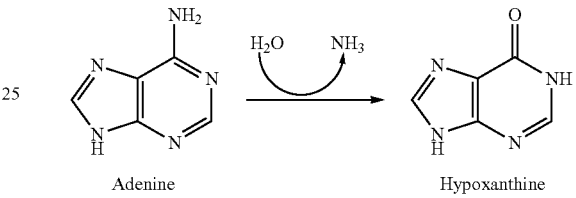

Adenine     Hypoxanthine

According to the present disclosure, adenosine deaminases that can be used in connection with the present disclosure include, but are not limited to, members of the enzyme family known as adenosine deaminases that act on RNA (ADARs), members of the enzyme family known as adenosine deaminases that act on tRNA (ADATs), and other adenosine deaminase domain-containing (ADAD) family members. According to the present disclosure, the adenosine deaminase is capable of targeting adenine in an RNA/DNA and RNA duplexes. Indeed, Zheng et al. (Nucleic Acids Res. 2017, 45(6): 3369-3377) demonstrate that ADARs can carry out adenosine to inosine editing reactions on RNA/DNA and RNA/RNA duplexes. In particular embodiments, the adenosine deaminase has been modified to increase its ability to edit DNA in an RNA/DNA heteroduplex of in an RNA duplex as detailed herein below.

In some embodiments, the adenosine deaminase is derived from one or more metazoa species, including but not limited to, mammals, birds, frogs, squids, fish, flies and worms. In some embodiments, the adenosine deaminase is a human, squid or *Drosophila* adenosine deaminase.

In some embodiments, the adenosine deaminase is a human ADAR, including hADAR1, hADAR2, hADAR3. In some embodiments, the adenosine deaminase is a *Caenorhabditis elegans* ADAR protein, including ADR-1 and ADR-2. In some embodiments, the adenosine deaminase is a *Drosophila* ADAR protein, including dAdar. In some embodiments, the adenosine deaminase is a squid *Loligo pealeii* ADAR protein, including sqADAR2a and sqADAR2b. In some embodiments, the adenosine deaminase is a human ADAT protein. In some embodiments, the adenosine deaminase is a *Drosophila* ADAT protein. In some embodiments, the adenosine deaminase is a human ADAD protein, including TENR (hADAD1) and TENRL (hADAD2).

In some embodiments, the adenosine deaminase is a TadA protein such as *E. coli* TadA. See Kim et al., Biochemistry 45:6407-6416 (2006); Wolf et al., EMBO J. 21:3841-3851 (2002). In some embodiments, the adenosine deaminase is mouse ADA. See Grunebaum et al., Curr. Opin. Allergy Clin. Immunol. 13:630-638 (2013). In some embodiments, the adenosine deaminase is human ADAT2. See Fukui et al., J. Nucleic Acids 2010:260512 (2010). In some embodiments, the deaminase (e.g., adenosine or cytidine deaminase) is one or more of those described in Cox et al., Science. 2017, November 24; 358(6366): 1019-1027; Komore et al., Nature. 2016 May 19;533(7603):420-4; and Gaudelli et al., Nature. 2017 Nov. 23; 551(7681):464-471.

In some embodiments, the adenosine deaminase protein recognizes and converts one or more target adenosine residue(s) in a double-stranded nucleic acid substrate into inosine residues (s). In some embodiments, the double-stranded nucleic acid substrate is a RNA-DNA hybrid duplex. In some embodiments, the adenosine deaminase protein recognizes a binding window on the double-stranded substrate. In some embodiments, the binding window contains at least one target adenosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the adenosine deaminase protein comprises one or more deaminase domains. Not intended to be bound by a particular theory, it is contemplated that the deaminase domain functions to recognize and convert one or more target adenosine (A) residue(s) contained in a double-stranded nucleic acid substrate into inosine (I) residue(s). In some embodiments, the deaminase domain comprises an active center. In some embodiments, the active center comprises a zinc ion. In some embodiments, during the A-to-I editing process, base pairing at the target adenosine residue is disrupted, and the target adenosine residue is "flipped" out of the double helix to become accessible by the adenosine deaminase. In some embodiments, amino acid residues in or near the active center interact with one or more nucleotide(s) 5' to a target adenosine residue. In some embodiments, amino acid residues in or near the active center interact with one or more nucleotide(s) 3' to a target adenosine residue. In some embodiments, amino acid residues in or near the active center further interact with the nucleotide complementary to the target adenosine residue on the opposite strand. In some embodiments, the amino acid residues form hydrogen bonds with the 2' hydroxyl group of the nucleotides.

In some embodiments, the adenosine deaminase comprises human ADAR2 full protein (hADAR2) or the deaminase domain thereof (hADAR2-D). In some embodiments, the adenosine deaminase is an ADAR family member that is homologous to hADAR2 or hADAR2-D.

Particularly, in some embodiments, the homologous ADAR protein is human ADAR1 (hADAR1) or the deaminase domain thereof (hADAR1-D). In some embodiments, glycine 1007 of hADAR1-D corresponds to glycine 487 hADAR2-D, and glutamic Acid 1008 of hADAR1-D corresponds to glutamic acid 488 of hADAR2-D.

In some embodiments, the adenosine deaminase comprises the wild-type amino acid sequence of hADAR2-D. In some embodiments, the adenosine deaminase comprises one or more mutations in the hADAR2-D sequence, such that the editing efficiency, and/or substrate editing preference of hADAR2-D is changed according to specific needs.

Certain mutations of hADAR1 and hADAR2 proteins have been described in Kuttan et al., Proc Natl Acad Sci USA. (2012) 109(48):E3295-304; Want et al. ACS Chem Biol. (2015) 10(11):2512-9; and Zheng et al. Nucleic Acids Res. (2017) 45(6):3369-337, each of which is incorporated herein by reference in its entirety.

In some embodiments, the adenosine deaminase comprises a mutation at glycine336 of the hADAR2-D amino acid sequence, or a corresponding position in a homologous ADAR protein. In some embodiments, the glycine residue at position 336 is replaced by an aspartic acid residue (G336D).

In some embodiments, the adenosine deaminase comprises a mutation at Glycine487 of the hADAR2-D amino acid sequence, or a corresponding position in a homologous ADAR protein. In some embodiments, the glycine residue at position 487 is replaced by a non-polar amino acid residue with relatively small side chains. For example, in some embodiments, the glycine residue at position 487 is replaced by an alanine residue (G487A). In some embodiments, the glycine residue at position 487 is replaced by a valine residue (G487V). In some embodiments, the glycine residue at position 487 is replaced by an amino acid residue with relatively large side chains. In some embodiments, the glycine residue at position 487 is replaced by a arginine residue (G487R). In some embodiments, the glycine residue at position 487 is replaced by a lysine residue (G487K). In some embodiments, the glycine residue at position 487 is replaced by a tryptophan residue (G487 W). In some embodiments, the glycine residue at position 487 is replaced by a tyrosine residue (G487Y).

In some embodiments, the adenosine deaminase comprises a mutation at glutamic acid488 of the hADAR2-D amino acid sequence, or a corresponding position in a homologous ADAR protein. In some embodiments, the glutamic acid residue at position 488 is replaced by a glutamine residue (E488Q). In some embodiments, the glutamic acid residue at position 488 is replaced by a histidine residue (E488H). In some embodiments, the glutamic acid residue at position 488 is replace by an arginine residue (E488R). In some embodiments, the glutamic acid residue at position 488 is replace by a lysine residue (E488K). In some embodiments, the glutamic acid residue at position 488 is replace by an asparagine residue (E488N). In some embodiments, the glutamic acid residue at position 488 is replace by an alanine residue (E488A). In some embodiments, the glutamic acid residue at position 488 is replace by a Methionine residue (E488M). In some embodiments, the glutamic acid residue at position 488 is replace by a serine residue (E488S). In some embodiments, the glutamic acid residue at position 488 is replace by a phenylalanine residue (E488F). In some embodiments, the glutamic acid residue at position 488 is replace by a lysine residue (E488L). In some embodiments, the glutamic acid residue at position 488 is replace by a tryptophan residue (E488 W).

In some embodiments, the adenosine deaminase comprises a mutation at threonine490 of the hADAR2-D amino acid sequence, or a corresponding position in a homologous ADAR protein. In some embodiments, the threonine residue at position 490 is replaced by a cysteine residue (T490C). In some embodiments, the threonine residue at position 490 is replaced by a serine residue (T490S). In some embodiments, the threonine residue at position 490 is replaced by an alanine residue (T490A). In some embodiments, the threonine residue at position 490 is replaced by a phenylalanine residue (T490F). In some embodiments, the threonine residue at position 490 is replaced by a tyrosine residue (T490Y). In some embodiments, the threonine residue at position 490 is replaced by a serine residue (T490R). In some embodiments, the threonine residue at position 490 is replaced by an alanine residue (T490K). In some embodiments, the threonine residue at position 490 is replaced by a phenylalanine residue (T490P). In some embodiments, the threonine residue at position 490 is replaced by a tyrosine residue (T490E).

In some embodiments, the adenosine deaminase comprises a mutation at valine493 of the hADAR2-D amino acid sequence, or a corresponding position in a homologous ADAR protein. In some embodiments, the valine residue at position 493 is replaced by an alanine residue (V493A). In some embodiments, the valine residue at position 493 is replaced by a serine residue (V493S). In some embodiments, the valine residue at position 493 is replaced by a threonine residue (V493T). In some embodiments, the valine residue at position 493 is replaced by an arginine residue (V493R). In some embodiments, the valine residue at position 493 is replaced by an aspartic acid residue (V493D). In some embodiments, the valine residue at position 493 is replaced by a proline residue (V493P). In some embodiments, the valine residue at position 493 is replaced by a glycine residue (V493G).

In some embodiments, the adenosine deaminase comprises a mutation at alanine589 of the hADAR2-D amino acid sequence, or a corresponding position in a homologous ADAR protein. In some embodiments, the alanine residue at position 589 is replaced by a valine residue (A589V).

In some embodiments, the adenosine deaminase comprises a mutation at asparagine597 of the hADAR2-D amino acid sequence, or a corresponding position in a homologous ADAR protein. In some embodiments, the asparagine residue at position 597 is replaced by a lysine residue (N597K). In some embodiments, the adenosine deaminase comprises a mutation at position 597 of the amino acid sequence, which has an asparagine residue in the wild type sequence. In some embodiments, the asparagine residue at position 597 is replaced by an arginine residue (N597R). In some embodiments, the adenosine deaminase comprises a mutation at position 597 of the amino acid sequence, which has an asparagine residue in the wild type sequence. In some embodiments, the asparagine residue at position 597 is replaced by an alanine residue (N597A). In some embodiments, the adenosine deaminase comprises a mutation at position 597 of the amino acid sequence, which has an asparagine residue in the wild type sequence. In some embodiments, the asparagine residue at position 597 is replaced by a glutamic acid residue (N597E). In some embodiments, the adenosine deaminase comprises a mutation at position 597 of the amino acid sequence, which has an asparagine residue in the wild type sequence. In some embodiments, the asparagine residue at position 597 is replaced by a histidine residue (N597H). In some embodiments, the adenosine deaminase comprises a mutation at position 597 of the amino acid sequence, which has an asparagine residue in the wild type sequence. In some embodiments, the asparagine residue at position 597 is replaced by a glycine residue (N597G). In some embodiments, the adenosine deaminase comprises a mutation at position 597 of the amino acid sequence, which has an asparagine residue in the wild type sequence. In some embodiments, the asparagine residue at position 597 is replaced by a tyrosine residue (N597Y). In some embodiments, the asparagine residue at position 597 is replaced by a phenylalanine residue (N597F). In some embodiments, the adenosine deaminase comprises mutation N597I. In some embodiments, the adenosine deaminase comprises mutation N597L. In some embodiments, the adenosine deaminase comprises mutation N597V. In some embodiments, the adenosine deaminase comprises mutation N597M. In some embodiments, the adenosine deaminase comprises mutation N597C. In some embodiments, the adenosine deaminase comprises mutation N597P. In some embodiments, the adenosine deaminase comprises mutation N597T. In some embodiments, the adenosine deaminase comprises mutation N597S. In some embodiments, the adenosine deaminase comprises mutation N597 W. In some embodiments, the adenosine deaminase comprises mutation N597Q. In some embodiments, the adenosine deaminase comprises mutation N597D. In certain example embodiments, the mutations at N597 described above are further made in the context of an E488Q background.

In some embodiments, the adenosine deaminase comprises a mutation at serine599 of the hADAR2-D amino acid sequence, or a corresponding position in a homologous ADAR protein. In some embodiments, the serine residue at position 599 is replaced by a threonine residue (S599T).

In some embodiments, the adenosine deaminase comprises a mutation at asparagine613 of the hADAR2-D amino acid sequence, or a corresponding position in a homologous ADAR protein. In some embodiments, the asparagine residue at position 613 is replaced by a lysine residue (N613K). In some embodiments, the adenosine deaminase comprises a mutation at position 613 of the amino acid sequence, which has an asparagine residue in the wild type sequence. In some embodiments, the asparagine residue at position 613 is replaced by an arginine residue (N613R). In some embodiments, the adenosine deaminase comprises a mutation at position 613 of the amino acid sequence, which has an asparagine residue in the wild type sequence. In some embodiments, the asparagine residue at position 613 is replaced by an alanine residue (N613A) In some embodiments, the adenosine deaminase comprises a mutation at position 613 of the amino acid sequence, which has an asparagine residue in the wild type sequence. In some embodiments, the asparagine residue at position 613 is replaced by a glutamic acid residue (N613E). In some embodiments, the adenosine deaminase comprises mutation N613I. In some embodiments, the adenosine deaminase comprises mutation N613L. In some embodiments, the adenosine deaminase comprises mutation N613V. In some embodiments, the adenosine deaminase comprises mutation N613F. In some embodiments, the adenosine deaminase comprises mutation N613M. In some embodiments, the adenosine deaminase comprises mutation N613C. In some embodiments, the adenosine deaminase comprises mutation N613G. In some embodiments, the adenosine deaminase comprises mutation N613P. In some embodiments, the adenosine deaminase comprises mutation N613T. In some embodiments, the adenosine deaminase comprises mutation N613S. In some embodiments, the adenosine deaminase comprises mutation N613Y. In some embodiments, the adenosine deaminase comprises mutation N613 W. In some embodiments, the adenosine deaminase comprises mutation N613Q. In some embodiments, the adenosine deaminase comprises mutation N613H. In some embodiments, the adenosine deaminase comprises mutation N613D. In some embodiments, the mutations at N613 described above are further made in combination with a E488Q mutation.

In some embodiments, to improve editing efficiency, the adenosine deaminase may comprise one or more of the mutations: G336D, G487A, G487V, E488Q, E488H, E488R, E488N, E488A, E488S, E488M, T490C, T490S, V493T, V493S, V493A, V493R, V493D, V493P, V493G, N597K, N597R, N597A, N597E, N597H, N597G, N597Y, A589V, S599T, N613K, N613R, N613A, N613E, based on amino acid sequence positions of hADAR2-D, and mutations in a homologous ADAR protein corresponding to the above.

In some embodiments, to reduce editing efficiency, the adenosine deaminase may comprise one or more of the mutations: E488F, E488L, E488 W, T490A, T490F, T490Y, T490R, T490K, T490P, T490E, N597F, based on amino acid sequence positions of hADAR2-D, and mutations in a homologous ADAR protein corresponding to the above. In particular embodiments, it can be of interest to use an adenosine deaminase enzyme with reduced efficacy to reduce off-target effects.

In some embodiments, to reduce off-target effects, the adenosine deaminase comprises one or more of mutations at R348, V351, T375, K376, E396, C451, R455, N473, R474, K475, R477, R481, S486, E488, T490, S495, R510, based on amino acid sequence positions of hADAR2-D, and mutations in a homologous ADAR protein corresponding to the above. In some embodiments, the adenosine deaminase comprises mutation at E488 and one or more additional positions selected from R348, V351, T375, K376, E396, C451, R455, N473, R474, K475, R477, R481, S486, T490, S495, R510. In some embodiments, the adenosine deaminase comprises mutation at T375, and optionally at one or more additional positions. In some embodiments, the adenosine deaminase comprises mutation at N473, and optionally at one or more additional positions. In some embodiments, the adenosine deaminase comprises mutation at V351, and optionally at one or more additional positions. In some embodiments, the adenosine deaminase comprises mutation at E488 and T375, and optionally at one or more additional positions. In some embodiments, the adenosine deaminase comprises mutation at E488 and N473, and optionally at one or more additional positions. In some embodiments, the adenosine deaminase comprises mutation E488 and V351, and optionally at one or more additional positions. In some embodiments, the adenosine deaminase comprises mutation at E488 and one or more of T375, N473, and V351.

In some embodiments, to reduce off-target effects, the adenosine deaminase comprises one or more of mutations selected from R348E, V351L, T375G, T375S, R455G, R455S, R455E, N473D, R474E, K475Q, R477E, R481E, S486T, E488Q, T490A, T490S, S495T, and R510E, based on amino acid sequence positions of hADAR2-D, and mutations in a homologous ADAR protein corresponding to the above. In some embodiments, the adenosine deaminase comprises mutation E488Q and one or more additional mutations selected from R348E, V351L, T375G, T375S, R455G, R455S, R455E, N473D, R474E, K475Q, R477E, R481E, S486T, T490A, T490S, S495T, and R510E. In some embodiments, the adenosine deaminase comprises mutation T375G or T375S, and optionally one or more additional mutations. In some embodiments, the adenosine deaminase comprises mutation N473D, and optionally one or more additional mutations. In some embodiments, the adenosine deaminase comprises mutation V351L, and optionally one or more additional mutations. In some embodiments, the adenosine deaminase comprises mutation E488Q, and T375G or T375G, and optionally one or more additional mutations. In some embodiments, the adenosine deaminase comprises mutation E488Q and N473D, and optionally one or more additional mutations. In some embodiments, the adenosine deaminase comprises mutation E488Q and V351L, and optionally one or more additional mutations. In some embodiments, the adenosine deaminase comprises mutation E488Q and one or more of T375G/S, N473D and V351L.

In certain examples, the adenosine deaminase protein or catalytic domain thereof has been modified to comprise a mutation at E488, preferably E488Q, of the hADAR2-D amino acid sequence, or a corresponding position in a homologous ADAR protein and/or wherein the adenosine deaminase protein or catalytic domain thereof has been modified to comprise a mutation at T375, preferably T375G of the hADAR2-D amino acid sequence, or a corresponding position in a homologous ADAR protein. In certain examples, the adenosine deaminase protein or catalytic domain thereof has been modified to comprise a mutation at E1008, preferably E1008Q, of the hADAR1d amino acid sequence, or a corresponding position in a homologous ADAR protein.

Crystal structures of the human ADAR2 deaminase domain bound to duplex RNA reveal a protein loop that binds the RNA on the 5' side of the modification site. This 5' binding loop is one contributor to substrate specificity differences between ADAR family members. See Wang et al., Nucleic Acids Res., 44(20):9872-9880 (2016), the content of which is incorporated herein by reference in its entirety. In addition, an ADAR2-specific RNA-binding loop was identified near the enzyme active site. See Mathews et al., Nat. Struct. Mol. Biol., 23(5):426-33 (2016), the content of which is incorporated herein by reference in its entirety. In some embodiments, the adenosine deaminase comprises one or more mutations in the RNA binding loop to improve editing specificity and/or efficiency.

In some embodiments, the adenosine deaminase comprises a mutation at alanine454 of the hADAR2-D amino acid sequence, or a corresponding position in a homologous ADAR protein. In some embodiments, the alanine residue at position 454 is replaced by a serine residue (A454S). In some embodiments, the alanine residue at position 454 is replaced by a cysteine residue (A454C). In some embodiments, the alanine residue at position 454 is replaced by an aspartic acid residue (A454D).

In some embodiments, the adenosine deaminase comprises a mutation at arginine455 of the hADAR2-D amino acid sequence, or a corresponding position in a homologous ADAR protein. In some embodiments, the arginine residue at position 455 is replaced by an alanine residue (R455A). In some embodiments, the arginine residue at position 455 is replaced by a valine residue (R455V). In some embodiments, the arginine residue at position 455 is replaced by a histidine residue (R455H). In some embodiments, the arginine residue at position 455 is replaced by a glycine residue (R455G). In some embodiments, the arginine residue at position 455 is replaced by a serine residue (R455S). In some embodiments, the arginine residue at position 455 is replaced by a glutamic acid residue (R455E). In some embodiments, the adenosine deaminase comprises mutation R455C. In some embodiments, the adenosine deaminase comprises mutation R455I. In some embodiments, the adenosine deaminase comprises mutation R455K. In some embodiments, the adenosine deaminase comprises mutation R455L. In some embodiments, the adenosine deaminase comprises mutation R455M. In some embodiments, the adenosine deaminase comprises mutation R455N. In some embodiments, the adenosine deaminase comprises mutation R455Q. In some embodiments, the adenosine deaminase comprises mutation R455F. In some embodiments, the adenosine deaminase comprises mutation R455 W. In some embodiments, the adenosine deaminase comprises mutation R455P. In some embodiments, the adenosine deaminase comprises mutation R455Y. In some embodiments, the adenosine deaminase comprises mutation R455E. In some embodiments, the adenosine deaminase comprises mutation R455D. In some embodiments, the mutations at R455 described above are further made in combination with a E488Q mutation.

In some embodiments, the adenosine deaminase comprises a mutation at isoleucine456 of the hADAR2-D amino acid sequence, or a corresponding position in a homologous ADAR protein. In some embodiments, the isoleucine residue at position 456 is replaced by a valine residue (I456V). In some embodiments, the isoleucine residue at position 456 is replaced by a leucine residue (I456L). In some embodiments, the isoleucine residue at position 456 is replaced by an aspartic acid residue (I456D).

In some embodiments, the adenosine deaminase comprises a mutation at phenylalanine457 of the hADAR2-D amino acid sequence, or a corresponding position in a homologous ADAR protein. In some embodiments, the phenylalanine residue at position 457 is replaced by a tyrosine residue (F457Y). In some embodiments, the phenylalanine residue at position 457 is replaced by an arginine residue (F457R). In some embodiments, the phenylalanine residue at position 457 is replaced by a glutamic acid residue (F457E).

In some embodiments, the adenosine deaminase comprises a mutation at serine458 of the hADAR2-D amino acid sequence, or a corresponding position in a homologous ADAR protein. In some embodiments, the serine residue at position 458 is replaced by a valine residue (S458V). In some embodiments, the serine residue at position 458 is replaced by a phenylalanine residue (S458F). In some embodiments, the serine residue at position 458 is replaced by a proline residue (S458P). In some embodiments, the adenosine deaminase comprises mutation S458I. In some embodiments, the adenosine deaminase comprises mutation S458L. In some embodiments, the adenosine deaminase comprises mutation S458M. In some embodiments, the adenosine deaminase comprises mutation S458C. In some embodiments, the adenosine deaminase comprises mutation S458A. In some embodiments, the adenosine deaminase comprises mutation S458G. In some embodiments, the adenosine deaminase comprises mutation S458T. In some embodiments, the adenosine deaminase comprises mutation S458Y. In some embodiments, the adenosine deaminase comprises mutation S458 W. In some embodiments, the adenosine deaminase comprises mutation S458Q. In some embodiments, the adenosine deaminase comprises mutation S458N. In some embodiments, the adenosine deaminase comprises mutation S458H. In some embodiments, the adenosine deaminase comprises mutation S458E. In some embodiments, the adenosine deaminase comprises mutation S458D. In some embodiments, the adenosine deaminase comprises mutation S458K. In some embodiments, the adenosine deaminase comprises mutation S458R. In some embodiments, the mutations at S458 described above are further made in combination with a E488Q mutation.

In some embodiments, the adenosine deaminase comprises a mutation at proline459 of the hADAR2-D amino acid sequence, or a corresponding position in a homologous ADAR protein. In some embodiments, the proline residue at position 459 is replaced by a cysteine residue (P459C). In some embodiments, the proline residue at position 459 is replaced by a histidine residue (P459H). In some embodiments, the proline residue at position 459 is replaced by a tryptophan residue (P459 W).

In some embodiments, the adenosine deaminase comprises a mutation at histidine460 of the hADAR2-D amino acid sequence, or a corresponding position in a homologous ADAR protein. In some embodiments, the histidine residue at position 460 is replaced by an arginine residue (H460R). In some embodiments, the histidine residue at position 460 is replaced by an isoleucine residue (H460I). In some embodiments, the histidine residue at position 460 is replaced by a proline residue (H460P). In some embodiments, the adenosine deaminase comprises mutation H460L. In some embodiments, the adenosine deaminase comprises mutation H460V. In some embodiments, the adenosine deaminase comprises mutation H460F. In some embodiments, the adenosine deaminase comprises mutation H460M. In some embodiments, the adenosine deaminase comprises mutation H460C. In some embodiments, the adenosine deaminase comprises mutation H460A. In some embodiments, the adenosine deaminase comprises mutation H460G. In some embodiments, the adenosine deaminase comprises mutation H460T. In some embodiments, the adenosine deaminase comprises mutation H460S. In some embodiments, the adenosine deaminase comprises mutation H460Y. In some embodiments, the adenosine deaminase comprises mutation H460 W. In some embodiments, the adenosine deaminase comprises mutation H460Q. In some embodiments, the adenosine deaminase comprises mutation H460N. In some embodiments, the adenosine deaminase comprises mutation H460E. In some embodiments, the adenosine deaminase comprises mutation H460D. In some embodiments, the adenosine deaminase comprises mutation H460K. In some embodiments, the mutations at H460 described above are further made in combination with a E488Q mutation.

In some embodiments, the adenosine deaminase comprises a mutation at proline462 of the hADAR2-D amino acid sequence, or a corresponding position in a homologous ADAR protein. In some embodiments, the proline residue at position 462 is replaced by a serine residue (P462S). In some embodiments, the proline residue at position 462 is replaced by a tryptophan residue (P462 W). In some embodiments, the proline residue at position 462 is replaced by a glutamic acid residue (P462E).

In some embodiments, the adenosine deaminase comprises a mutation at aspartic acid469 of the hADAR2-D amino acid sequence, or a corresponding position in a homologous ADAR protein. In some embodiments, the aspartic acid residue at position 469 is replaced by a glutamine residue (D469Q). In some embodiments, the aspartic acid residue at position 469 is replaced by a serine residue (D469S). In some embodiments, the aspartic acid residue at position 469 is replaced by a tyrosine residue (D469Y).

In some embodiments, the adenosine deaminase comprises a mutation at arginine470 of the hADAR2-D amino acid sequence, or a corresponding position in a homologous ADAR protein. In some embodiments, the arginine residue at position 470 is replaced by an alanine residue (R470A). In some embodiments, the arginine residue at position 470 is replaced by an isoleucine residue (R470I). In some embodiments, the arginine residue at position 470 is replaced by an aspartic acid residue (R470D).

In some embodiments, the adenosine deaminase comprises a mutation at histidine471 of the hADAR2-D amino acid sequence, or a corresponding position in a homologous ADAR protein. In some embodiments, the histidine residue at position 471 is replaced by a lysine residue (H471K). In some embodiments, the histidine residue at position 471 is replaced by a threonine residue (H471T). In some embodiments, the histidine residue at position 471 is replaced by a valine residue (H471V).

In some embodiments, the adenosine deaminase comprises a mutation at proline472 of the hADAR2-D amino acid sequence, or a corresponding position in a homologous ADAR protein. In some embodiments, the proline residue at position 472 is replaced by a lysine residue (P472K). In some embodiments, the proline residue at position 472 is replaced by a threonine residue (P472T). In some embodiments, the proline residue at position 472 is replaced by an aspartic acid residue (P472D).

In some embodiments, the adenosine deaminase comprises a mutation at asparagine473 of the hADAR2-D amino acid sequence, or a corresponding position in a homologous ADAR protein. In some embodiments, the asparagine residue at position 473 is replaced by an arginine residue (N473R). In some embodiments, the asparagine residue at position 473 is replaced by a tryptophan residue (N473 W). In some embodiments, the asparagine residue at position 473 is replaced by a proline residue (N473P). In some embodiments, the asparagine residue at position 473 is replaced by an aspartic acid residue (N473D).

In some embodiments, the adenosine deaminase comprises a mutation at arginine 474 of the hADAR2-D amino acid sequence, or a corresponding position in a homologous ADAR protein. In some embodiments, the arginine residue at position 474 is replaced by a lysine residue (R474K). In some embodiments, the arginine residue at position 474 is replaced by a glycine residue (R474G). In some embodiments, the arginine residue at position 474 is replaced by an aspartic acid residue (R474D). In some embodiments, the arginine residue at position 474 is replaced by a glutamic acid residue (R474E).

In some embodiments, the adenosine deaminase comprises a mutation at lysine475 of the hADAR2-D amino acid sequence, or a corresponding position in a homologous ADAR protein. In some embodiments, the lysine residue at position 475 is replaced by a glutamine residue (K475Q). In some embodiments, the lysine residue at position 475 is replaced by an asparagine residue (K475N). In some embodiments, the lysine residue at position 475 is replaced by an aspartic acid residue (K475D).

In some embodiments, the adenosine deaminase comprises a mutation at alanine476 of the hADAR2-D amino acid sequence, or a corresponding position in a homologous ADAR protein. In some embodiments, the alanine residue at position 476 is replaced by a serine residue (A476S). In some embodiments, the alanine residue at position 476 is replaced by an arginine residue (A476R). In some embodiments, the alanine residue at position 476 is replaced by a glutamic acid residue (A476E).

In some embodiments, the adenosine deaminase comprises a mutation at arginine477 of the hADAR2-D amino acid sequence, or a corresponding position in a homologous ADAR protein. In some embodiments, the arginine residue at position 477 is replaced by a lysine residue (R477K). In some embodiments, the arginine residue at position 477 is replaced by a threonine residue (R477T). In some embodiments, the arginine residue at position 477 is replaced by a phenylalanine residue (R477F). In some embodiments, the arginine residue at position 474 is replaced by a glutamic acid residue (R477E).

In some embodiments, the adenosine deaminase comprises a mutation at glycine478 of the hADAR2-D amino acid sequence, or a corresponding position in a homologous ADAR protein. In some embodiments, the glycine residue at position 478 is replaced by an alanine residue (G478A). In some embodiments, the glycine residue at position 478 is replaced by an arginine residue (G478R). In some embodiments, the glycine residue at position 478 is replaced by a tyrosine residue (G478Y). In some embodiments, the adenosine deaminase comprises mutation G478I. In some embodiments, the adenosine deaminase comprises mutation G478L. In some embodiments, the adenosine deaminase comprises mutation G478V. In some embodiments, the adenosine deaminase comprises mutation G478F. In some embodiments, the adenosine deaminase comprises mutation G478M. In some embodiments, the adenosine deaminase comprises mutation G478C. In some embodiments, the adenosine deaminase comprises mutation G478P. In some embodiments, the adenosine deaminase comprises mutation G478T. In some embodiments, the adenosine deaminase comprises mutation G478S. In some embodiments, the adenosine deaminase comprises mutation G478 W. In some embodiments, the adenosine deaminase comprises mutation G478Q. In some embodiments, the adenosine deaminase comprises mutation G478N. In some embodiments, the adenosine deaminase comprises mutation G478H. In some embodiments, the adenosine deaminase comprises mutation G478E. In some embodiments, the adenosine deaminase comprises mutation G478D. In some embodiments, the adenosine deaminase comprises mutation G478K. In some embodiments, the mutations at G478 described above are further made in combination with a E488Q mutation.

In some embodiments, the adenosine deaminase comprises a mutation at glutamine479 of the hADAR2-D amino acid sequence, or a corresponding position in a homologous ADAR protein. In some embodiments, the glutamine residue at position 479 is replaced by an asparagine residue (Q479N). In some embodiments, the glutamine residue at position 479 is replaced by a serine residue (Q479S). In some embodiments, the glutamine residue at position 479 is replaced by a proline residue (Q479P).

In some embodiments, the adenosine deaminase comprises a mutation at arginine348 of the hADAR2-D amino acid sequence, or a corresponding position in a homologous ADAR protein. In some embodiments, the arginine residue at position 348 is replaced by an alanine residue (R348A). In some embodiments, the arginine residue at position 348 is replaced by a glutamic acid residue (R348E).

In some embodiments, the adenosine deaminase comprises a mutation at valine351 of the hADAR2-D amino acid sequence, or a corresponding position in a homologous ADAR protein. In some embodiments, the valine residue at position 351 is replaced by a leucine residue (V351L). In some embodiments, the adenosine deaminase comprises mutation V351Y. In some embodiments, the adenosine deaminase comprises mutation V351M. In some embodiments, the adenosine deaminase comprises mutation V351T. In some embodiments, the adenosine deaminase comprises mutation V351G. In some embodiments, the adenosine deaminase comprises mutation V351A. In some embodiments, the adenosine deaminase comprises mutation V351F. In some embodiments, the adenosine deaminase comprises mutation V351E. In some embodiments, the adenosine deaminase comprises mutation V351I. In some embodiments, the adenosine deaminase comprises mutation V351C. In some embodiments, the adenosine deaminase comprises mutation V351H. In some embodiments, the adenosine deaminase comprises mutation V351P. In some embodiments, the adenosine deaminase comprises mutation V351S. In some embodiments, the adenosine deaminase comprises mutation V351K. In some embodiments, the adenosine deaminase comprises mutation V351N. In some embodiments, the adenosine deaminase comprises mutation V351 W. In some embodiments, the adenosine deaminase comprises mutation V351Q. In some embodiments, the adenosine deaminase comprises mutation V351D. In some embodiments, the adenosine deaminase comprises mutation V351R. In some embodiments, the mutations at V351 described above are further made in combination with a E488Q mutation.

In some embodiments, the adenosine deaminase comprises a mutation at threonine375 of the hADAR2-D amino acid sequence, or a corresponding position in a homologous ADAR protein. In some embodiments, the threonine residue at position 375 is replaced by a glycine residue (T375G). In some embodiments, the threonine residue at position 375 is replaced by a serine residue (T375S). In some embodiments, the adenosine deaminase comprises mutation T375H. In some embodiments, the adenosine deaminase comprises mutation T375Q. In some embodiments, the adenosine deaminase comprises mutation T375C. In some embodiments, the adenosine deaminase comprises mutation T375N. In some embodiments, the adenosine deaminase comprises mutation T375M. In some embodiments, the adenosine deaminase comprises mutation T375A. In some embodiments, the adenosine deaminase comprises mutation T375 W. In some embodiments, the adenosine deaminase comprises mutation T375V. In some embodiments, the adenosine deaminase comprises mutation T375R. In some embodiments, the adenosine deaminase comprises mutation T375E. In some embodiments, the adenosine deaminase comprises mutation T375K. In some embodiments, the adenosine deaminase comprises mutation T375F. In some embodiments, the adenosine deaminase comprises mutation T375I. In some embodiments, the adenosine deaminase comprises mutation T375D. In some embodiments, the adenosine deaminase comprises mutation T375P. In some embodiments, the adenosine deaminase comprises mutation T375L. In some embodiments, the adenosine deaminase comprises mutation T375Y. In some embodiments, the mutations at T375Y described above are further made in combination with an E488Q mutation.

In some embodiments, the adenosine deaminase comprises a mutation at Arg481 of the hADAR2-D amino acid sequence, or a corresponding position in a homologous ADAR protein. In some embodiments, the arginine residue at position 481 is replaced by a glutamic acid residue (R481E).

In some embodiments, the adenosine deaminase comprises a mutation at Ser486 of the hADAR2-D amino acid sequence, or a corresponding position in a homologous ADAR protein. In some embodiments, the serine residue at position 486 is replaced by a threonine residue (S486T).

In some embodiments, the adenosine deaminase comprises a mutation at Thr490 of the hADAR2-D amino acid sequence, or a corresponding position in a homologous ADAR protein. In some embodiments, the threonine residue at position 490 is replaced by an alanine residue (T490A). In some embodiments, the threonine residue at position 490 is replaced by a serine residue (T490S).

In some embodiments, the adenosine deaminase comprises a mutation at Ser495 of the hADAR2-D amino acid sequence, or a corresponding position in a homologous ADAR protein. In some embodiments, the serine residue at position 495 is replaced by a threonine residue (S495T).

In some embodiments, the adenosine deaminase comprises a mutation at Arg510 of the hADAR2-D amino acid sequence, or a corresponding position in a homologous ADAR protein. In some embodiments, the arginine residue at position 510 is replaced by a glutamine residue (R510Q). In some embodiments, the arginine residue at position 510 is replaced by an alanine residue (R510A). In some embodiments, the arginine residue at position 510 is replaced by a glutamic acid residue (R510E).

In some embodiments, the adenosine deaminase comprises a mutation at Gly593 of the hADAR2-D amino acid sequence, or a corresponding position in a homologous ADAR protein. In some embodiments, the glycine residue at position 593 is replaced by an alanine residue (G593A). In some embodiments, the glycine residue at position 593 is replaced by a glutamic acid residue (G593E).

In some embodiments, the adenosine deaminase comprises a mutation at Lys594 of the hADAR2-D amino acid sequence, or a corresponding position in a homologous ADAR protein. In some embodiments, the lysine residue at position 594 is replaced by an alanine residue (K594A).

In some embodiments, the adenosine deaminase comprises a mutation at any one or more of positions A454, R455, I456, F457, S458, P459, H460, P462, D469, R470, H471, P472, N473, R474, K475, A476, R477, G478, Q479, R348, R510, G593, K594 of the hADAR2-D amino acid sequence, or a corresponding position in a homologous ADAR protein.

In some embodiments, the adenosine deaminase comprises any one or more of mutations A454S, A454C, A454D, R455A, R455V, R455H, I456V, I456L, I456D, F457Y, F457R, F457E, S458V, S458F, S458P, P459C, P459H, P459 W, H460R, H460I, H460P, P462S, P462 W, P462E, D469Q, D469S, D469Y, R470A, R470I, R470D, H471K, H471T, H471V, P472K, P472T, P472D, N473R, N473 W, N473P, R474K, R474G, R474D, K475Q, K475N, K475D, A476S, A476R, A476E, R477K, R477T, R477F, G478A, G478R, G478Y, Q479N, Q479S, Q479P, R348A, R510Q, R510A, G593A, G593E, K594A of the hADAR2-D amino acid sequence, or a corresponding position in a homologous ADAR protein.

In certain embodiments the adenosine deaminase is mutated to convert the activity to cytidine deaminase. Accordingly in some embodiments, the adenosine deaminase comprises one or more mutations in positions selected from E396, C451, V351, R455, T375, K376, S486, Q488, R510, K594, R348, G593, S397, H443, L444, Y445, F442, E438, T448, A353, V355, T339, P539, T339, P539, V525 1520, P462 and N579. In particular embodiments, the adenosine deaminase comprises one or more mutations in a position selected from V351, L444, V355, V525 and I520. In some embodiments, the adenosine deaminase may comprise one or more of mutations at E488, V351, S486, T375, S370, P462, N597, based on amino acid sequence positions of hADAR2-D, and mutations in a homologous ADAR protein corresponding to the above.

In some embodiments, the adenosine deaminase may comprise one or more of the mutations: E488Q based on amino acid sequence positions of hADAR2-D, and mutations in a homologous ADAR protein corresponding to the above. In some embodiments, the adenosine deaminase may comprise one or more of the mutations: E488Q, V351G, based on amino acid sequence positions of hADAR2-D, and mutations in a homologous ADAR protein corresponding to the above. In some embodiments, the adenosine deaminase may comprise one or more of the mutations: E488Q, V351G, S486A, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E, S661T based on amino acid sequence positions of hADAR2-D, and mutations in a homologous ADAR protein corresponding to the above. In some examples, provided herein includes a mutated adenosine deaminase e.g., an adenosine deaminase comprising one or more mutations of E488Q, V351G, S486A, T375S, S370C, P462A, N597I, L332I, I398V, K350I, M383L, D619G, S582T, V440I, S495N, K418E, S661T, fused with a dead CRISPR-Cas protein or CRISPR-Cas nickase. In a particular example, provided herein includes a mutated adenosine deaminase e.g., an adenosine deaminase comprising E488Q, V351G, S486A, T375S, S370C, P462A, N597I, L332I, I398V, K350I, M383L, D619G, S582T, V440I, S495N, K418E, and S661T, fused with a dead CRISPR-Cas protein or a CRISPR-Cas nickase.

In some embodiments, the adenosine deaminase comprises a mutation at any one or more of positions T375, V351, G478, S458, H460 of the hADAR2-D amino acid sequence, or a corresponding position in a homologous ADAR protein, optionally in combination a mutation at E488. In some embodiments, the adenosine deaminase comprises one or more of mutations selected from T375G, T375C, T375H, T375Q, V351M, V351T, V351Y, G478R, S458F, H460I, optionally in combination with E488Q.

In some embodiments, the adenosine deaminase comprises one or more of mutations selected from T375H, T375Q, V351M, V351Y, H460P, optionally in combination with E488Q.

In some embodiments, the adenosine deaminase comprises mutations T375S and S458F, optionally in combination with E488Q.

In some embodiments, the adenosine deaminase comprises a mutation at two or more of positions T375, N473, R474, G478, S458, P459, V351, R455, R455, T490, R348, Q479 of the hADAR2-D amino acid sequence, or a corresponding position in a homologous ADAR protein, optionally in combination a mutation at E488. In some embodiments, the adenosine deaminase comprises two or more of mutations selected from T375G, T375S, N473D, R474E, G478R, S458F, P459 W, V351L, R455G, R455S, T490A, R348E, Q479P, optionally in combination with E488Q.

In some embodiments, the adenosine deaminase comprises mutations T375G and V351L. In some embodiments, the adenosine deaminase comprises mutations T375G and R455G. In some embodiments, the adenosine deaminase comprises mutations T375G and R455S. In some embodiments, the adenosine deaminase comprises mutations T375G and T490A. In some embodiments, the adenosine deaminase comprises mutations T375G and R348E. In some embodiments, the adenosine deaminase comprises mutations T375S and V351L. In some embodiments, the adenosine deaminase comprises mutations T375S and R455G. In some embodiments, the adenosine deaminase comprises mutations T375S and R455S. In some embodiments, the adenosine deaminase comprises mutations T375S and T490A. In some embodiments, the adenosine deaminase comprises mutations T375S and R348E. In some embodiments, the adenosine deaminase comprises mutations N473D and V351L. In some embodiments, the adenosine deaminase comprises mutations N473D and R455G. In some embodiments, the adenosine deaminase comprises mutations N473D and R455S. In some embodiments, the adenosine deaminase comprises mutations N473D and T490A. In some embodiments, the adenosine deaminase comprises mutations N473D and R348E. In some embodiments, the adenosine deaminase comprises mutations R474E and V351L. In some embodiments, the adenosine deaminase comprises mutations R474E and R455G. In some embodiments, the adenosine deaminase comprises mutations R474E and R455S. In some embodiments, the adenosine deaminase comprises mutations R474E and T490A. In some embodiments, the adenosine deaminase comprises mutations R474E and R348E. In some embodiments, the adenosine deaminase comprises mutations S458F and T375G. In some embodiments, the adenosine deaminase comprises mutations S458F and T375S. In some embodiments, the adenosine deaminase comprises mutations S458F and N473D. In some embodiments, the adenosine deaminase comprises mutations S458F and R474E. In some embodiments, the adenosine deaminase comprises mutations S458F and G478R. In some embodiments, the adenosine deaminase comprises mutations G478R and T375G. In some embodiments, the adenosine deaminase comprises mutations G478R and T375S. In some embodiments, the adenosine deaminase comprises mutations G478R and N473D. In some embodiments, the adenosine deaminase comprises mutations G478R and R474E. In some embodiments, the adenosine deaminase comprises mutations P459 W and T375G. In some embodiments, the adenosine deaminase comprises mutations P459 W and T375S. In some embodiments, the adenosine deaminase comprises mutations P459 W and N473D. In some embodiments, the adenosine deaminase comprises mutations P459 W and R474E. In some embodiments, the adenosine deaminase comprises mutations P459 W and G478R. In some embodiments, the adenosine deaminase comprises mutations P459 W and S458F. In some embodiments, the adenosine deaminase comprises mutations Q479P and T375G. In some embodiments, the adenosine deaminase comprises mutations Q479P and T375S. In some embodiments, the adenosine deaminase comprises mutations Q479P and N473D. In some embodiments, the adenosine deaminase comprises mutations Q479P and R474E. In some embodiments, the adenosine deaminase comprises mutations Q479P and G478R. In some embodiments, the adenosine deaminase comprises mutations Q479P and S458F. In some embodiments, the adenosine deaminase comprises mutations Q479P and P459 W. All mutations described in this paragraph may also further be made in combination with a E488Q mutations.

In some embodiments, the adenosine deaminase comprises a mutation at any one or more of positions K475, Q479, P459, G478, S458 of the hADAR2-D amino acid sequence, or a corresponding position in a homologous ADAR protein, optionally in combination a mutation at E488. In some embodiments, the adenosine deaminase comprises one or more of mutations selected from K475N, Q479N, P459 W, G478R, S458P, S458F, optionally in combination with E488Q.

In some embodiments, the adenosine deaminase comprises a mutation at any one or more of positions T375, V351, R455, H460, A476 of the hADAR2-D amino acid sequence, or a corresponding position in a homologous ADAR protein, optionally in combination a mutation at E488. In some embodiments, the adenosine deaminase comprises one or more of mutations selected from T375G, T375C, T375H, T375Q, V351M, V351T, V351Y, R455H, H460P, H460I, A476E, optionally in combination with E488Q.

In certain embodiments, improvement of editing and reduction of off-target modification is achieved by chemical modification of gRNAs. gRNAs which are chemically modified as exemplified in Vogel et al. (2014), Angew Chem Int Ed, 53:6267-6271, doi:10.1002/anie.201402634 (incorporated herein by reference in its entirety) reduce off-target activity and improve on-target efficiency. 2'-O-methyl and phosphothioate modified guide RNAs in general improve editing efficiency in cells.

ADAR has been known to demonstrate a preference for neighboring nucleotides on either side of the edited A (www.nature.com/nsmb/journal/v23/n5/full/nsmb.3203.html, Matthews et al. (2017), Nature Structural Mol Biol, 23(5): 426-433, incorporated herein by reference in its entirety). Accordingly, in certain embodiments, the gRNA, target, and/or ADAR is selected optimized for motif preference.

Intentional mismatches have been demonstrated in vitro to allow for editing of non-preferred motifs (academic.oup.com/nar/article-lookup/doi/10.1093/nar/gku272; Schneider et al (2014), Nucleic Acid Res, 42(10):e87); Fukuda et al. (2017), Scientific Reports, 7, doi:10.1038/srep41478, incorporated herein by reference in its entirety). Accordingly, in certain embodiments, to enhance RNA editing efficiency on non-preferred 5' or 3' neighboring bases, intentional mismatches in neighboring bases are introduced.

In some embodiments, the adenosine deaminase may be a tRNA-specific adenosine deaminase or a variant thereof. In some embodiments, the adenosine deaminase may comprise one or more of the mutations: W23L, W23R, R26G, H36L, N37S, P48S, P48T, P48A, I49V, R51L, N72D, L84F, S97C, A106V, D108N, H123Y, G125A, A142N, S146C, D147Y, R152H, R152P, E155V, I156F, K157N, K161T, based on amino acid sequence positions of E. coli TadA, and mutations in a homologous deaminase protein corresponding to the above. In some embodiments, the adenosine deaminase may comprise one or more of the mutations: D108N based on amino acid sequence positions of E. coli TadA, and mutations in a homologous deaminase protein corresponding to the above. In some embodiments, the adenosine deaminase may comprise one or more of the mutations: A106V, D108N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, based on amino acid sequence positions of E. coli TadA, and mutations in a homologous deaminase protein corresponding to the above. In some embodiments, the adenosine deaminase may comprise one or more of the mutations: A106V, D108N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, A142N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, A142N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, A142N, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, based on amino acid sequence positions of E. coli TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, A142N, based on amino acid sequence positions of E. coli TadA, and mutations in a homologous deaminase protein corresponding to the above.

Results suggest that A's opposite C's in the targeting window of the ADAR deaminase domain are preferentially edited over other bases. Additionally, A's base-paired with U's within a few bases of the targeted base show low levels of editing by Cas-ADAR fusions, suggesting that there is flexibility for the enzyme to edit multiple A's. These two observations suggest that multiple A's in the activity window of Cas-ADAR fusions could be specified for editing by mismatching all A's to be edited with C's. Accordingly, in certain embodiments, multiple A:C mismatches in the activity window are designed to create multiple A:I edits. In certain embodiments, to suppress potential off-target editing in the activity window, non-target A's are paired with A's or G's.

The terms "editing specificity" and "editing preference" are used interchangeably herein to refer to the extent of A-to-I editing at a particular adenosine site in a double-stranded substrate. In some embodiment, the substrate editing preference is determined by the 5' nearest neighbor and/or the 3' nearest neighbor of the target adenosine residue. In some embodiments, the adenosine deaminase has preference for the 5' nearest neighbor of the substrate ranked as U>A>C>G (">" indicates greater preference). In some embodiments, the adenosine deaminase has preference for the 3' nearest neighbor of the substrate ranked as G>C-A>U (">" indicates greater preference; "~" indicates similar preference). In some embodiments, the adenosine deaminase has preference for the 3' nearest neighbor of the substrate ranked as G>C>U-A (">" indicates greater preference; "~" indicates similar preference). In some embodiments, the adenosine deaminase has preference for the 3' nearest neighbor of the substrate ranked as G>C>A>U (">" indicates greater preference). In some embodiments, the adenosine deaminase has preference for the 3' nearest neighbor of the substrate ranked as C~G~A>U (">" indicates greater preference; "~" indicates similar preference). In some embodiments, the adenosine deaminase has preference for a triplet sequence containing the target adenosine residue ranked as TAG>AAG>CAC>AAT>GAA>GAC (">" indicates greater preference), the center A being the target adenosine residue.

In some embodiments, the substrate editing preference of an adenosine deaminase is affected by the presence or absence of a nucleic acid binding domain in the adenosine deaminase protein. In some embodiments, to modify substrate editing preference, the deaminase domain is connected with a double-strand RNA binding domain (dsRBD) or a double-strand RNA binding motif (dsRBM). In some embodiments, the dsRBD or dsRBM may be derived from an ADAR protein, such as hADAR1 or hADAR2. In some embodiments, a full length ADAR protein that comprises at least one dsRBD and a deaminase domain is used. In some embodiments, the one or more dsRBM or dsRBD is at the N-terminus of the deaminase domain. In other embodiments, the one or more dsRBM or dsRBD is at the C-terminus of the deaminase domain.

In some embodiments, the substrate editing preference of an adenosine deaminase is affected by amino acid residues near or in the active center of the enzyme. In some embodiments, to modify substrate editing preference, the adenosine deaminase may comprise one or more of the mutations: G336D, G487R, G487K, G487 W, G487Y, E488Q, E488N, T490A, V493A, V493T, V493S, N597K, N597R, A589V, S599T, N613K, N613R, based on amino acid sequence positions of hADAR2-D, and mutations in a homologous ADAR protein corresponding to the above.

Particularly, in some embodiments, to reduce editing specificity, the adenosine deaminase can comprise one or more of mutations E488Q, V493A, N597K, N613K, based on amino acid sequence positions of hADAR2-D, and mutations in a homologous ADAR protein corresponding to the above. In some embodiments, to increase editing specificity, the adenosine deaminase can comprise mutation T490A.

In some embodiments, to increase editing preference for target adenosine (A) with an immediate 5' G, such as substrates comprising the triplet sequence GAC, the center A being the target adenosine residue, the adenosine deaminase can comprise one or more of mutations G336D, E488Q, E488N, V493T, V493S, V493A, A589V, N597K, N597R, S599T, N613K, N613R, based on amino acid sequence positions of hADAR2-D, and mutations in a homologous ADAR protein corresponding to the above.

Particularly, in some embodiments, the adenosine deaminase comprises mutation E488Q or a corresponding mutation in a homologous ADAR protein for editing substrates comprising the following triplet sequences: GAC, GAA, GAU, GAG, CAU, AAU, UAC, the center A being the target adenosine residue.

In some embodiments, the adenosine deaminase comprises the wild-type amino acid sequence of hADAR1-D as defined in SEQ ID No. 761. In some embodiments, the adenosine deaminase comprises one or more mutations in the hADAR1-D sequence, such that the editing efficiency, and/or substrate editing preference of hADAR1-D is changed according to specific needs.

In some embodiments, the adenosine deaminase comprises a mutation at Glycine1007 of the hADAR1-D amino acid sequence, or a corresponding position in a homologous ADAR protein. In some embodiments, the glycine residue at position 1007 is replaced by a non-polar amino acid residue with relatively small side chains. For example, in some embodiments, the glycine residue at position 1007 is replaced by an alanine residue (G1007A). In some embodiments, the glycine residue at position 1007 is replaced by a valine residue (G1007V). In some embodiments, the glycine residue at position 1007 is replaced by an amino acid residue with relatively large side chains. In some embodiments, the glycine residue at position 1007 is replaced by an arginine residue (G1007R). In some embodiments, the glycine residue at position 1007 is replaced by a lysine residue (G1007K). In some embodiments, the glycine residue at position 1007 is replaced by a tryptophan residue (G1007 W). In some embodiments, the glycine residue at position 1007 is replaced by a tyrosine residue (G1007Y). Additionally, in other embodiments, the glycine residue at position 1007 is replaced by a leucine residue (G1007L). In other embodiments, the glycine residue at position 1007 is replaced by a threonine residue (G1007T). In other embodiments, the glycine residue at position 1007 is replaced by a serine residue (G1007S).

In some embodiments, the adenosine deaminase comprises a mutation at glutamic acid1008 of the hADAR1-D amino acid sequence, or a corresponding position in a homologous ADAR protein. In some embodiments, the glutamic acid residue at position 1008 is replaced by a polar amino acid residue having a relatively large side chain. In some embodiments, the glutamic acid residue at position 1008 is replaced by a glutamine residue (E1008Q). In some embodiments, the glutamic acid residue at position 1008 is replaced by a histidine residue (E1008H). In some embodiments, the glutamic acid residue at position 1008 is replaced by an arginine residue (E1008R). In some embodiments, the glutamic acid residue at position 1008 is replaced by a lysine residue (E1008K). In some embodiments, the glutamic acid residue at position 1008 is replaced by a nonpolar or small polar amino acid residue. In some embodiments, the glutamic acid residue at position 1008 is replaced by a phenylalanine residue (E1008F). In some embodiments, the glutamic acid residue at position 1008 is replaced by a tryptophan residue (E1008 W). In some embodiments, the glutamic acid residue at position 1008 is replaced by a glycine residue (E1008G). In some embodiments, the glutamic acid residue at position 1008 is replaced by an isoleucine residue (E1008I). In some embodiments, the glutamic acid residue at position 1008 is replaced by a valine residue (E1008V). In some embodiments, the glutamic acid residue at position 1008 is replaced by a proline residue (E1008P). In some embodiments, the glutamic acid residue at position 1008 is replaced by a serine residue (E1008S). In other embodiments, the glutamic acid residue at position 1008 is replaced by an asparagine residue (E1008N). In other embodiments, the glutamic acid residue at position 1008 is replaced by an alanine residue (E1008A). In other embodiments, the glutamic acid residue at position 1008 is replaced by a Methionine residue (E1008M). In some embodiments, the glutamic acid residue at position 1008 is replaced by a leucine residue (E1008L).

In some embodiments, to improve editing efficiency, the adenosine deaminase may comprise one or more of the mutations: E1007S, E1007A, E1007V, E1008Q, E1008R, E1008H, E1008M, E1008N, E1008K, based on amino acid sequence positions of hADAR1-D, and mutations in a homologous ADAR protein corresponding to the above.

In some embodiments, to reduce editing efficiency, the adenosine deaminase may comprise one or more of the mutations: E1007R, E1007K, E1007Y, E1007L, E1007T, E1008G, E1008I, E1008P, E1008V, E1008F, E1008 W, E1008S, E1008N, E1008K, based on amino acid sequence positions of hADAR1-D, and mutations in a homologous ADAR protein corresponding to the above.

In some embodiments, the substrate editing preference, efficiency and/or selectivity of an adenosine deaminase is affected by amino acid residues near or in the active center of the enzyme. In some embodiments, the adenosine deaminase comprises a mutation at the glutamic acid 1008 position in hADAR1-D sequence, or a corresponding position in a homologous ADAR protein. In some embodiments, the mutation is E1008R, or a corresponding mutation in a homologous ADAR protein. In some embodiments, the E1008R mutant has an increased editing efficiency for target adenosine residue that has a mismatched G residue on the opposite strand.

In some embodiments, the adenosine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the adenosine deaminase and the double-stranded substrate is mediated by one or more additional protein factor(s), including a CRISPR/CAS protein factor. In some embodiments, the interaction between the adenosine deaminase and the double-stranded substrate is further mediated by one or more nucleic acid component(s), including a guide RNA.

In certain example embodiments, directed evolution may be used to design modified ADAR proteins capable of catalyzing additional reactions besides deamination of a adenine to a hypoxanthine.

Modified Adenosine Deaminase Having C to U Deamination Activity

In certain example embodiments, directed evolution may be used to design modified ADAR proteins capable of catalyzing additional reactions besides deamination of an adenine to a hypoxanthine. For example, the modified ADAR protein may be capable of catalyzing deamination of a cytidine to a uracil. While not bound by a particular theory, mutations that improve C to U activity may alter the shape of the binding pocket to be more amenable to the smaller cytidine base.

In some embodiments, the modified adenosine deaminase having C-to-U deamination activity comprises a mutation at any one or more of positions V351, T375, R455, and E488 of the hADAR2-D amino acid sequence, or a corresponding position in a homologous ADAR protein. In some embodiments, the adenosine deaminase comprises mutation E488Q. In some embodiments, the adenosine deaminase comprises one or more of mutations selected from V351I, V351L, V351F, V351M, V351C, V351A, V351G, V351P, V351T, V351S, V351Y, V351 W, V351Q, V351N, V351H, V351E, V351D, V351K, V351R, T375I, T375L, T375V, T375F, T375M, T375C, T375A, T375G, T375P, T375S, T375Y, T375 W, T375Q, T375N, T375H, T375E, T375D, T375K, T375R, R455I, R455L, R455V, R455F, R455M, R455C, R455A, R455G, R455P, R455T, R455S, R455Y, R455 W, R455Q, R455N, R455H, R455E, R455D, R455K. In some embodiments, the adenosine deaminase comprises mutation E488Q, and further comprises one or more of mutations selected from V351I, V351L, V351F, V351M, V351C, V351A, V351G, V351P, V351T, V351S, V351Y, V351 W, V351Q, V351N, V351H, V351E, V351D, V351K, V351R, T375I, T375L, T375V, T375F, T375M, T375C, T375A, T375G, T375P, T375S, T375Y, T375 W, T375Q, T375N, T375H, T375E, T375D, T375K, T375R, R4551, R455L, R455V, R455F, R455M, R455C, R455A, R455G, R455P, R455T, R455S, R455Y, R455 W, R455Q, R455N, R455H, R455E, R455D, R455K.

In connection with the aforementioned modified ADAR protein having C-to-U deamination activity, the invention described herein also relates to a method for deaminating a C in a target RNA sequence of interest, comprising delivering to a target RNA or DNA an AD-functionalized composition disclosed herein.

In certain example embodiments, the method for deaminating a C in a target RNA sequence comprising delivering to said target RNA: (a) a catalytically inactive (dead) Cas; (b) a guide molecule which comprises a guide sequence linked to a direct repeat sequence; and (c) a modified ADAR protein having C-to-U deamination activity or catalytic domain thereof, wherein said modified ADAR protein or catalytic domain thereof is covalently or non-covalently linked to said dead Cas protein or said guide molecule or is adapted to link thereto after delivery; wherein guide molecule forms a complex with said dead Cas protein and directs said complex to bind said target RNA sequence of interest; wherein said guide sequence is capable of hybridizing with a target sequence comprising said C to form an RNA duplex; wherein, optionally, said guide sequence comprises a non-pairing A or U at a position corresponding to said C resulting in a mismatch in the RNA duplex formed; and wherein said modified ADAR protein or catalytic domain thereof deaminates said C in said RNA duplex.

In connection with the aforementioned modified ADAR protein having C-to-U deamination activity, the invention described herein further relates to an engineered, non-naturally occurring system suitable for deaminating a C in a target locus of interest, comprising: (a) a guide molecule which comprises a guide sequence linked to a direct repeat sequence, or a nucleotide sequence encoding said guide molecule; (b) a catalytically inactive Cas protein, or a nucleotide sequence encoding said catalytically inactive Cas protein; (c) a modified ADAR protein having C-to-U deamination activity or catalytic domain thereof, or a nucleotide sequence encoding said modified ADAR protein or catalytic domain thereof, wherein said modified ADAR protein or catalytic domain thereof is covalently or non-covalently linked to said Cas protein or said guide molecule or is adapted to link thereto after delivery; wherein said guide sequence is capable of hybridizing with a target RNA sequence comprising a C to form an RNA duplex; wherein, optionally, said guide sequence comprises a non-pairing A or U at a position corresponding to said C resulting in a mismatch in the RNA duplex formed; wherein, optionally, the system is a vector system comprising one or more vectors comprising: (a) a first regulatory element operably linked to a nucleotide sequence encoding said guide molecule which comprises said guide sequence, (b) a second regulatory element operably linked to a nucleotide sequence encoding said catalytically inactive Cas protein; and (c) a nucleotide sequence encoding a modified ADAR protein having C-to-U deamination activity or catalytic domain thereof which is under control of said first or second regulatory element or operably linked to a third regulatory element; wherein, if said nucleotide sequence encoding a modified ADAR protein or catalytic domain thereof is operably linked to a third regulatory element, said modified ADAR protein or catalytic domain thereof is adapted to link to said guide molecule or said Cas protein after expression; wherein components (a), (b) and (c) are located on the same or different vectors of the system, optionally wherein said first, second, and/or third regulatory element is an inducible promoter.

In an embodiment of the invention, the substrate of the adenosine deaminase is an RNA/DNA heteroduplex formed upon binding of the guide molecule to its DNA target which then forms the CRISPR-Cas complex with the CRISPR-Cas enzyme. The RNA/DNA or DNA/RNA heteroduplex is also referred to herein as the "RNA/DNA hybrid", "DNA/RNA hybrid" or "double-stranded substrate".

According to the present invention, the substrate of the adenosine deaminase is an RNA/DNAn RNA duplex formed upon binding of the guide molecule to its DNA target which then forms the CRISPR-Cas complex with the CRISPR-Cas enzyme. The substrate of the adenosine deaminase can also be an RNA/RNA duplex formed upon binding of the guide molecule to its RNA target which then forms the CRISPR-Cas complex with the CRISPR-Cas enzyme. The RNA/DNA or DNA/RNAn RNA duplex is also referred to herein as the "RNA/DNA hybrid", "DNA/RNA hybrid" or "double-stranded substrate". The particular features of the guide molecule and CRISPR-Cas enzyme are detailed below.

The term "editing selectivity" as used herein refers to the fraction of all sites on a double-stranded substrate that is edited by an adenosine deaminase. Without being bound by theory, it is contemplated that editing selectivity of an adenosine deaminase is affected by the double-stranded substrate's length and secondary structures, such as the presence of mismatched bases, bulges and/or internal loops.

In some embodiments, when the substrate is a perfectly base-paired duplex longer than 50 bp, the adenosine deaminase may be able to deaminate multiple adenosine residues within the duplex (e.g., 50% of all adenosine residues). In some embodiments, when the substrate is shorter than 50 bp, the editing selectivity of an adenosine deaminase is affected by the presence of a mismatch at the target adenosine site. Particularly, in some embodiments, adenosine (A) residue having a mismatched cytidine (C) residue on the opposite strand is deaminated with high efficiency. In some embodiments, adenosine (A) residue having a mismatched guanosine (G) residue on the opposite strand is skipped without editing.

In particular embodiments, the adenosine deaminase protein or catalytic domain thereof is delivered to the cell or expressed within the cell as a separate protein, but is modified so as to be able to link to either the Cas protein or the guide molecule. In particular embodiments, this is ensured by the use of orthogonal RNA-binding protein or adaptor protein/aptamer combinations that exist within the diversity of bacteriophage coat proteins. Examples of such coat proteins include but are not limited to: MS2, QP, F2, GA, fr, JP501, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s and PRR1. Aptamers can be naturally occurring or synthetic oligonucleotides that have been engineered through repeated rounds of in vitro selection or SELEX (systematic evolution of ligands by exponential enrichment) to bind to a specific target.

In particular embodiments, the guide molecule is provided with one or more distinct RNA loop(s) or distinct sequence(s) that can recruit an adaptor protein. A guide molecule may be extended, without colliding with the Cas protein by the insertion of distinct RNA loop(s) or distinct sequence(s) that may recruit adaptor proteins that can bind to the distinct RNA loop(s) or distinct sequence(s). Examples of modified guides and their use in recruiting effector domains to the Cas complex are provided in Konermann (Nature 2015, 517(7536): 583-588). In particular embodiments, the aptamer is a minimal hairpin aptamer which selectively binds dimerized MS2 bacteriophage coat proteins in mammalian cells and is introduced into the guide molecule, such as in the stemloop and/or in a tetraloop. In these embodiments, the adenosine deaminase protein is fused to MS2. The adenosine deaminase protein is then co-delivered together with the Cas protein and corresponding guide RNA.

In some embodiments, the Cas-ADAR base editing system described herein comprises (a) a Cas protein, which is catalytically inactive or a nickase; (b) a guide molecule which comprises a guide sequence; and (c) an adenosine deaminase protein or catalytic domain thereof, wherein the adenosine deaminase protein or catalytic domain thereof is covalently or non-covalently linked to the Cas protein or the guide molecule or is adapted to link thereto after delivery; wherein the guide sequence is substantially complementary to the target sequence but comprises a non-pairing C corresponding to the A being targeted for deamination, resulting in a A-C mismatch in a DNA-RNA or RNA-RNA duplex formed by the guide sequence and the target sequence. For application in eukaryotic cells, the Cas protein and/or the adenosine deaminase are preferably NLS-tagged.

In some embodiments, the components (a), (b) and (c) are delivered to the cell as a ribonucleoprotein complex. The ribonucleoprotein complex can be delivered via one or more lipid nanoparticles.

In some embodiments, the components (a), (b) and (c) are delivered to the cell as one or more RNA molecules, such as one or more guide RNAs and one or more mRNA molecules encoding the Cas protein, the adenosine deaminase protein, and optionally the adaptor protein. The RNA molecules can be delivered via one or more lipid nanoparticles.

In some embodiments, the components (a), (b) and (c) are delivered to the cell as one or more DNA molecules. In some embodiments, the one or more DNA molecules are comprised within one or more vectors such as viral vectors (e.g., AAV). In some embodiments, the one or more DNA molecules comprise one or more regulatory elements operably configured to express the Cas protein, the guide molecule, and the adenosine deaminase protein or catalytic domain thereof, optionally wherein the one or more regulatory elements comprise inducible promoters.

In some embodiments of the guide molecule is capable of hybridizing with a target sequence comprising the Adenine to be deaminated within a first DNA strand or a RNA strand at the target locus to form a DNA-RNA or RNA-RNA duplex which comprises a non-pairing Cytosine opposite to said Adenine. Upon duplex formation, the guide molecule forms a complex with the Cas protein and directs the complex to bind said first DNA strand or said RNA strand at the target locus of interest. Details on the aspect of the guide of the Cas-ADAR base editing system are provided herein below.

In some embodiments, a Cas guide RNA having a canonical length (e.g., about 20 nt for AacC2c1) is used to form a DNA-RNA or RNA-RNA duplex with the target DNA or RNA. In some embodiments, a Cas guide molecule longer than the canonical length (e.g., >20 nt for AacC2c1) is used to form a DNA-RNA or RNA-RNA duplex with the target DNA or RNA including outside of the Cas-guide RNA-target DNA complex. In certain example embodiments, the guide sequence has a length of about 29-53 nt capable of forming a DNA-RNA or RNA-RNA duplex with said target sequence. In certain other example embodiments, the guide sequence has a length of about 40-50 nt capable of forming a DNA-RNA or RNA-RNA duplex with said target sequence. In certain example embodiments, the distance between said non-pairing C and the 5' end of said guide sequence is 20-30 nucleotides. In certain example embodiments, the distance between said non-pairing C and the 3' end of said guide sequence is 20-30 nucleotides.

In at least a first design, the Cas-ADAR system comprises (a) an adenosine deaminase fused or linked to a Cas protein, wherein the Cas protein is catalytically inactive or a nickase, and (b) a guide molecule comprising a guide sequence designed to introduce a A-C mismatch in a DNA-RNA or RNA-RNA duplex formed between the guide sequence and the target sequence. In some embodiments, the Cas protein and/or the adenosine deaminase are NLS-tagged, on either the N- or C-terminus or both.

In at least a second design, the Cas-ADAR system comprises (a) a Cas protein that is catalytically inactive or a nickase, (b) a guide molecule comprising a guide sequence designed to introduce a A-C mismatch in a DNA-RNA or RNA-RNA duplex formed between the guide sequence and the target sequence, and an aptamer sequence (e.g., MS2 RNA motif or PP7 RNA motif) capable of binding to an adaptor protein (e.g., MS2 coating protein or PP7 coat protein), and (c) an adenosine deaminase fused or linked to an adaptor protein, wherein the binding of the aptamer and the adaptor protein recruits the adenosine deaminase to the DNA-RNA or RNA-RNA duplex formed between the guide sequence and the target sequence for targeted deamination at the A of the A-C mismatch. In some embodiments, the adaptor protein and/or the adenosine deaminase are NLS-tagged, on either the N- or C-terminus or both. The Cas protein can also be NLS-tagged.

The use of different aptamers and corresponding adaptor proteins also allows orthogonal gene editing to be implemented. In one example in which adenosine deaminase are used in combination with cytidine deaminase for orthogonal gene editing/deamination, sgRNA targeting different loci are modified with distinct RNA loops in order to recruit MS2-adenosine deaminase and PP7-cytidine deaminase (or PP7-adenosine deaminase and MS2-cytidine deaminase), respectively, resulting in orthogonal deamination of A or C at the target loci of interested, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-adenosine deaminase, while another sgRNA targeting locus B can be modified with PP7 loops, recruiting PP7-cytidine deaminase. In the same cell, orthogonal, locus-specific modifications are thus realized. This principle can be extended to incorporate other orthogonal RNA-binding proteins.

In at least a third design, the Cas-ADAR CRISPR system comprises (a) an adenosine deaminase inserted into an internal loop or unstructured region of a Cas protein, wherein the Cas protein is catalytically inactive or a nickase, and (b) a guide molecule comprising a guide sequence designed to introduce a A-C mismatch in a DNA-RNA or RNA-RNA duplex formed between the guide sequence and the target sequence.

Cas protein split sites that are suitable for insertion of adenosine deaminase can be identified with the help of a crystal structure. For example, with respect to AacC2c1 mutants, it should be readily apparent what the corresponding position for, for example, a sequence alignment. For other Cas protein one can use the crystal structure of an ortholog if a relatively high degree of homology exists between the ortholog and the intended Cas protein.

The split position may be located within a region or loop. Preferably, the split position occurs where an interruption of the amino acid sequence does not result in the partial or full destruction of a structural feature (e.g. alpha-helixes or β-sheets). Unstructured regions (regions that did not show up in the crystal structure because these regions are not structured enough to be "frozen" in a crystal) are often preferred options. Splits in all unstructured regions that are exposed on the surface of Cas are envisioned in the practice of the invention. The positions within the unstructured regions or outside loops may not need to be exactly the numbers provided above, but may vary by, for example 1, 2, 3, 4, 5, 6, 7, 8, 9, or even 10 amino acids either side of the position given above, depending on the size of the loop, so long as the split position still falls within an unstructured region of outside loop.

The Cas-ADAR system described herein can be used to target a specific Adenine within a DNA sequence for deamination. For example, the guide molecule can form a complex with the Cas protein and directs the complex to bind a target sequence at the target locus of interest. Because the guide sequence is designed to have a non-pairing C, the heteroduplex formed between the guide sequence and the target sequence comprises a A-C mismatch, which directs the adenosine deaminase to contact and deaminate the A opposite to the non-pairing C, converting it to a Inosine (I). Since Inosine (I) base pairs with C and functions like G in cellular process, the targeted deamination of A described herein are useful for correction of undesirable G-A and C-T mutations, as well as for obtaining desirable A-G and T-C mutations.

Base Excision Repair Inhibitor

In some embodiments, the AD-functionalized CRISPR system further comprises a base excision repair (BER) inhibitor. Without wishing to be bound by any particular theory, cellular DNA-repair response to the presence of I:T pairing may be responsible for a decrease in nucleobase editing efficiency in cells. Alkyladenine DNA glycosylase (also known as DNA-3-methyladenine glycosylase, 3-alkyladenine DNA glycosylase, or N-methylpurine DNA glycosylase) catalyzes removal of hypoxanthine from DNA in cells, which may initiate base excision repair, with reversion of the I:T pair to a A:T pair as outcome.

In some embodiments, the BER inhibitor is an inhibitor of alkyladenine DNA glycosylase. In some embodiments, the BER inhibitor is an inhibitor of human alkyladenine DNA glycosylase. In some embodiments, the BER inhibitor is a polypeptide inhibitor. In some embodiments, the BER inhibitor is a protein that binds hypoxanthine. In some embodiments, the BER inhibitor is a protein that binds hypoxanthine in DNA. In some embodiments, the BER inhibitor is a catalytically inactive alkyladenine DNA glycosylase protein or binding domain thereof. In some embodiments, the BER inhibitor is a catalytically inactive alkyladenine DNA glycosylase protein or binding domain thereof that does not excise hypoxanthine from the DNA. Other proteins that are capable of inhibiting (e.g., sterically blocking) an alkyladenine DNA glycosylase base-excision repair enzyme are within the scope of this disclosure. Additionally, any proteins that block or inhibit base-excision repair as also within the scope of this disclosure.

Without wishing to be bound by any particular theory, base excision repair may be inhibited by molecules that bind the edited strand, block the edited base, inhibit alkyladenine DNA glycosylase, inhibit base excision repair, protect the edited base, and/or promote fixing of the non-edited strand. It is believed that the use of the BER inhibitor described herein can increase the editing efficiency of an adenosine deaminase that is capable of catalyzing a A to I change.

Accordingly, in the first design of the AD-functionalized CRISPR system discussed above, the CRISPR-Cas protein or the adenosine deaminase can be fused to or linked to a BER inhibitor (e.g., an inhibitor of alkyladenine DNA glycosylase). In some embodiments, the BER inhibitor can be comprised in one of the following structures (nCas=Cas nickase; dCas=dead Cas): [AD]-[optional linker]-[nCas/dCas]-[optional linker]-[BER inhibitor]; [AD]-[optional linker]-[BER inhibitor]-[optional linker]-[nCas/dCas]; [BER inhibitor]-[optional linker]-[AD]-[optional linker]-[nCas/dCas]; [BER inhibitor]-[optional linker]-[nCas/dCas]-[optional linker]-[AD]; [nCas/dCas]-[optional linker]-[AD]-[optional linker]-[BER inhibitor]; [nCas/dCas]-[optional linker]-[BER inhibitor]-[optional linker]-[AD].

Similarly, in the second design of the AD-functionalized CRISPR system discussed above, the CRISPR-Cas protein, the adenosine deaminase, or the adaptor protein can be fused to or linked to a BER inhibitor (e.g., an inhibitor of alkyladenine DNA glycosylase). In some embodiments, the BER inhibitor can be comprised in one of the following structures (nCas=Cas nickase; dCas=dead Cas): [nCas/dCas]-[optional linker]-[BER inhibitor]; [BER inhibitor]-[optional linker]-[nCas/dCas]; [AD]-[optional linker]-[Adaptor]-[optional linker]-[BER inhibitor]; [AD]-[optional linker]-[BER inhibitor]-[optional linker]-[Adaptor]; [BER inhibitor]-[optional linker]-[AD]-[optional linker]-[Adaptor]; [BER inhibitor]-[optional linker]-[Adaptor]-[optional linker]-[AD]; [Adaptor]-[optional linker]-[AD]-[optional linker]-[BER inhibitor]; [Adaptor]-[optional linker]-[BER inhibitor]-[optional linker]-[AD].

In the third design of the AD-functionalized CRISPR system discussed above, the BER inhibitor can be inserted into an internal loop or unstructured region of a CRISPR-Cas protein.

Cytidine Deaminase

In some embodiments, the deaminase is a cytidine deaminase. The term "cytidine deaminase" or "cytidine deaminase protein" as used herein refers to a protein, a polypeptide, or one or more functional domain(s) of a protein or a polypeptide that is capable of catalyzing a hydrolytic deamination reaction that converts a cytosine (or a cytosine moiety of a molecule) to an uracil (or a uracil moiety of a molecule), as shown below. In some embodiments, the cytosine-containing molecule is an cytidine (C), and the uracil-containing molecule is an uridine (U). The cytosine-containing molecule can be deoxyribonucleic acid (DNA) or ribonucleic acid (RNA).

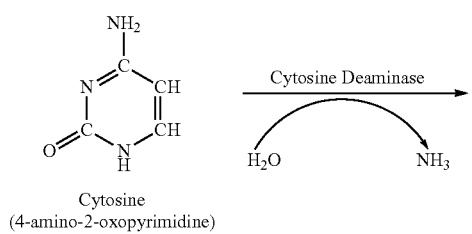

Cytosine
(4-amino-2-oxopyrimidine)

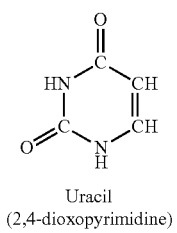

Uracil
(2,4-dioxopyrimidine)

According to the present disclosure, cytidine deaminases that can be used in connection with the present disclosure include, but are not limited to, members of the enzyme family known as apolipoprotein B mRNA-editing complex (APOBEC) family deaminase, an activation-induced deaminase (AID), or a cytidine deaminase 1 (CDA1). In particular embodiments, the deaminase in an APOBEC1 deaminase, an APOBEC2 deaminase, an APOBEC3A deaminase, an APOBEC3B deaminase, an APOBEC3C deaminase, and APOBEC3D deaminase, an APOBEC3E deaminase, an APOBEC3F deaminase an APOBEC3G deaminase, an APOBEC3H deaminase, or an APOBEC4 deaminase.

In the methods and systems of the present invention, the cytidine deaminase is capable of targeting Cytosine in a DNA single strand. In certain example embodiments the cytidine deaminase may edit on a single strand present outside of the binding component e.g. bound Cas. In other example embodiments, the cytidine deaminase may edit at a localized bubble, such as a localized bubble formed by a mismatch at the target edit site but the guide sequence. In certain example embodiments the cytidine deaminase may contain mutations that help focus the area of activity such as those disclosed in Kim et al., Nature Biotechnology (2017) 35(4):371-377 (doi:10.1038/nbt.3803.

In some embodiments, the cytidine deaminase is derived from one or more metazoa species, including but not limited to, mammals, birds, frogs, squids, fish, flies and worms. In some embodiments, the cytidine deaminase is a human, primate, cow, dog rat or mouse cytidine deaminase.

In some embodiments, the cytidine deaminase is a human APOBEC, including hAPOBEC1 or hAPOBEC3. In some embodiments, the cytidine deaminase is a human AID.

In some embodiments, the cytidine deaminase protein recognizes and converts one or more target cytosine residue (s) in a single-stranded bubble of a RNA duplex into uracil residues (s). In some embodiments, the cytidine deaminase protein recognizes a binding window on the single-stranded bubble of a RNA duplex. In some embodiments, the binding window contains at least one target cytosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the cytidine deaminase protein comprises one or more deaminase domains. Not intended to be bound by theory, it is contemplated that the deaminase domain functions to recognize and convert one or more target cytosine (C) residue(s) contained in a single-stranded bubble of a RNA duplex into (an) uracil (U) residue (s). In some embodiments, the deaminase domain comprises an active center. In some embodiments, the active center comprises a zinc ion. In some embodiments, amino acid residues in or near the active center interact with one or more nucleotide(s) 5' to a target cytosine residue. In some embodiments, amino acid residues in or near the active center interact with one or more nucleotide(s) 3' to a target cytosine residue.

In some embodiments, the cytidine deaminase comprises human APOBEC1 full protein (hAPOBEC1) or the deaminase domain thereof (hAPOBEC1-D) or a C-terminally truncated version thereof (hAPOBEC-T). In some embodiments, the cytidine deaminase is an APOBEC family member that is homologous to hAPOBEC1, hAPOBEC-D or hAPOBEC-T. In some embodiments, the cytidine deaminase comprises human AID1 full protein (hAID) or the deaminase domain thereof (hAID-D) or a C-terminally truncated version thereof (hAID-T). In some embodiments, the cytidine deaminase is an AID family member that is homologous to hAID, hAID-D or hAID-T. In some embodiments, the hAID-T is a hAID which is C-terminally truncated by about 20 amino acids.

In some embodiments, the cytidine deaminase comprises the wild-type amino acid sequence of a cytosine deaminase. In some embodiments, the cytidine deaminase comprises one or more mutations in the cytosine deaminase sequence, such that the editing efficiency, and/or substrate editing preference of the cytosine deaminase is changed according to specific needs.

Certain mutations of APOBEC1 and APOBEC3 proteins have been described in Kim et al., Nature Biotechnology (2017) 35(4):371-377 (doi:10.1038/nbt.3803); and Harris et al. Mol. Cell (2002) 10:1247-1253, each of which is incorporated herein by reference in its entirety.

In some embodiments, the cytidine deaminase is an APOBEC1 deaminase comprising one or more mutations at amino acid positions corresponding to W90, R118, H121, H122, R126, or R132 in rat APOBEC1, or an APOBEC3G deaminase comprising one or more mutations at amino acid positions corresponding to W285, R313, D316, D317X, R320, or R326 in human APOBEC3G.

In some embodiments, the cytidine deaminase comprises a mutation at tryptophane90 of the rat APOBEC1 amino acid sequence, or a corresponding position in a homologous APOBEC protein, such as tryptophane285 of APOBEC3G. In some embodiments, the tryptophan residue at position 90 is replaced by an tyrosine or phenylalanine residue (W90Y or W90F).

In some embodiments, the cytidine deaminase comprises a mutation at Argininel18 of the rat APOBEC1 amino acid sequence, or a corresponding position in a homologous APOBEC protein. In some embodiments, the arginine residue at position 118 is replaced by an alanine residue (RI 18A).

In some embodiments, the cytidine deaminase comprises a mutation at Histidinel21 of the rat APOBEC1 amino acid sequence, or a corresponding position in a homologous APOBEC protein. In some embodiments, the histidine residue at position 121 is replaced by an arginine residue (H121R).

In some embodiments, the cytidine deaminase comprises a mutation at Histidine122 of the rat APOBEC1 amino acid sequence, or a corresponding position in a homologous APOBEC protein. In some embodiments, the histidine residue at position 122 is replaced by an arginine residue (H122R).

In some embodiments, the cytidine deaminase comprises a mutation at Arginine126 of the rat APOBEC1 amino acid sequence, or a corresponding position in a homologous APOBEC protein, such as Arginine320 of APOBEC3G. In some embodiments, the arginine residue at position 126 is replaced by an alanine residue (R126A) or by a glutamic acid (R126E).

In some embodiments, the cytidine deaminase comprises a mutation at arginine132 of the APOBEC1 amino acid sequence, or a corresponding position in a homologous APOBEC protein. In some embodiments, the arginine residue at position 132 is replaced by a glutamic acid residue (R132E).

In some embodiments, to narrow the width of the editing window, the cytidine deaminase may comprise one or more of the mutations: W90Y, W90F, R126E and R132E, based on amino acid sequence positions of rat APOBEC1, and mutations in a homologous APOBEC protein corresponding to the above.

In some embodiments, to reduce editing efficiency, the cytidine deaminase may comprise one or more of the mutations: W90A, R118A, R132E, based on amino acid sequence positions of rat APOBEC1, and mutations in a homologous APOBEC protein corresponding to the above. In particular embodiments, it can be of interest to use a cytidine deaminase enzyme with reduced efficacy to reduce off-target effects.

In some embodiments, the cytidine deaminase is wild-type rat APOBEC1 (rAPOBEC1, or a catalytic domain thereof. In some embodiments, the cytidine deaminase comprises one or more mutations in the rAPOBEC1 sequence, such that the editing efficiency, and/or substrate editing preference of rAPOBEC1 is changed according to specific needs.

rAPOBEC 1 :
(SEQ ID NO: 72)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLK

In some embodiments, the cytidine deaminase is wild-type human APOBEC1 (rAPOBEC1) or a catalytic domain thereof. In some embodiments, the cytidine deaminase comprises one or more mutations in the hAPOBEC1 sequence, such that the editing efficiency, and/or substrate editing preference of hAPOBEC1 is changed according to specific needs.

APOBEC1:
(SEQ ID NO: 173)
MTSEKGPSTGDPTLRRRIEPWEFDVFYDPRELRKEACLLYEIKWGMSRKI

WRSSGKNTTNHVEVNFIKKFTSERDFHPSMSCSITWFLSWSPCWECSQAI

REFLSRHPGVTLVIYVARLFWHMDQQNRQGLRDLVNSGVTIQIMRASEYY

HCWRNFVNYPPGDEAHWPQYPPLWMMLYALELHCIILSLPPCLKISRRWQ

NHLTFFRLHLQNCHYQTIPPHILLATGLIHPSVAWR

In some embodiments, the cytidine deaminase is wild-type human APOBEC3G (hAPOBEC3G) or a catalytic domain thereof. In some embodiments, the cytidine deaminase comprises one or more mutations in the hAPOBEC3G sequence, such that the editing efficiency, and/or substrate editing preference of hAPOBEC3G is changed according to specific needs.

hAPOBEC3G:
(SEQ ID NO: 174)
MELKYHPEMRFFHWFSKWRKLHRDQEYEVTWYISWSPCTKCTRDMATFLA

EDPKVTLTIFVARLYYFWDPDYQEALRSLCQKRDGPRATMKIMNYDEFQH

CWSKFVYSQRELFEPWNNLPKYYILLHIMLGEILRHSMDPPTFTENENNE

PWVRGRHETYLCYEVERMHNDTWVLLNQRRGELCNQAPHKHGELEGRHAE

LCFLDVIPFWKLDLDQDYRVTCFTSWSPCFSCAQEMAKFISKNKHVSLCI

FTARIYDDQGRCQEGLRTLAEAGAKISIMTYSEFKHCWDTFVDHQGCPFQ

PWDGLDEHSQDLSGRLRAILQNQEN

In some embodiments, the cytidine deaminase is wild-type *Petromyzon marinus* CDA1 (pmCDA1) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

pmCDA1:
(SEQ ID NO: 175)
MTDAEYVRIHEKLDIYTFKKQFFNNKKSVSHRCYVLFELKRRGERRACFW

GYAVNKPQSGTERGIHAEIFSIRKVEEYLRDNPGQFTINWYSSWSPCADC

AEKILEWYNQELRGNGHTLKIWACKLYYEKNARNQIGLWNLRDNGVGLNV

MVSEHYQCCRKIFIQSSHNQLNENRWLEKTLKRAEKRRSELSIMIQVKIL

HTTKSPAV

In some embodiments, the cytidine deaminase is wild-type human AID (hAID) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

hAID:
(SEQ ID NO: 176)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPYLSLRIFTARLYFCEDRKAEPEGLRRLHRAGVQIAIMTFKDYFYCWNT

FVENHERTFKAWEGLHENSVRLSRQLRRILLPLYEVDDLRDAFRTLGLLD

In some embodiments, the cytidine deaminase is truncated version of hAID (hAID-DC) or a catalytic domain thereof. In some embodiments, the cytidine deaminase comprises one or more mutations in the hAID-DC sequence, such that the editing efficiency, and/or substrate editing preference of hAID-DC is changed according to specific needs.

hAID-DC:
(SEQ ID NO: 177)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPNLSLRIFTARLYFCEDRKAEPEGLRRLHRAGVQIAIMTFKDYFYCWNT

FVENHERTFKAWEGLHENSVRLSRQLRRILL

Additional embodiments of the cytidine deaminase are disclosed in WO WO2017/070632, titled "Nucleobase Editor and Uses Thereof," which is incorporated herein by reference in its entirety.

In some embodiments, the cytidine deaminase has an efficient deamination window that encloses the nucleotides susceptible to deamination editing. Accordingly, in some embodiments, the "editing window width" refers to the number of nucleotide positions at a given target site for which editing efficiency of the cytidine deaminase exceeds the half-maximal value for that target site. In some embodiments, the cytidine deaminase has an editing window width in the range of about 1 to about 6 nucleotides. In some embodiments, the editing window width of the cytidine deaminase is 1, 2, 3, 4, 5, or 6 nucleotides.

Not intended to be bound by theory, it is contemplated that in some embodiments, the length of the linker sequence affects the editing window width. In some embodiments, the editing window width increases (e.g., from about 3 to about 6 nucleotides) as the linker length extends (e.g., from about 3 to about 21 amino acids). In a non-limiting example, a 16-residue linker offers an efficient deamination window of about 5 nucleotides. In some embodiments, the length of the guide RNA affects the editing window width. In some embodiments, shortening the guide RNA leads to a narrowed efficient deamination window of the cytidine deaminase.

In some embodiments, mutations to the cytidine deaminase affect the editing window width. In some embodiments, the cytidine deaminase component of the CD-functionalized CRISPR system comprises one or more mutations that reduce the catalytic efficiency of the cytidine deaminase, such that the deaminase is prevented from deamination of multiple cytidines per DNA binding event. In some embodiments, tryptophan at residue 90 (W90) of APOBEC1 or a corresponding tryptophan residue in a homologous sequence is mutated. In some embodiments, the catalytically inactive Cas is fused to or linked to an APOBEC1 mutant that comprises a W90Y or W90F mutation. In some embodiments, tryptophan at residue 285 (W285) of APOBEC3G, or a corresponding tryptophan residue in a homologous sequence is mutated. In some embodiments, the catalytically inactive Cas is fused to or linked to an APOBEC3G mutant that comprises a W285Y or W285F mutation.

In some embodiments, the cytidine deaminase component of CD-functionalized CRISPR system comprises one or more mutations that reduce tolerance for non-optimal presentation of a cytidine to the deaminase active site. In some embodiments, the cytidine deaminase comprises one or more mutations that alter substrate binding activity of the deaminase active site. In some embodiments, the cytidine deaminase comprises one or more mutations that alter the conformation of DNA to be recognized and bound by the deaminase active site. In some embodiments, the cytidine deaminase comprises one or more mutations that alter the substrate accessibility to the deaminase active site. In some embodiments, arginine at residue 126 (R126) of APOBEC1 or a corresponding arginine residue in a homologous sequence is mutated. In some embodiments, the catalytically inactive Cas is fused to or linked to an APOBEC1 that comprises a R126A or R126E mutation. In some embodiments, tryptophan at residue 320 (R320) of APOBEC3G, or a corresponding arginine residue in a homologous sequence is mutated. In some embodiments, the catalytically inactive Cas is fused to or linked to an APOBEC3G mutant that comprises a R320A or R320E mutation. In some embodiments, arginine at residue 132 (R132) of APOBEC1 or a corresponding arginine residue in a homologous sequence is mutated. In some embodiments, the catalytically inactive Cas is fused to or linked to an APOBEC1 mutant that comprises a R132E mutation.

In some embodiments, the APOBEC1 domain of the CD-functionalized CRISPR system comprises one, two, or three mutations selected from W90Y, W90F, R126A, R126E, and R132E. In some embodiments, the APOBEC1 domain comprises double mutations of W90Y and R126E. In some embodiments, the APOBEC1 domain comprises double mutations of W90Y and R132E. In some embodiments, the APOBEC1 domain comprises double mutations of R126E and R132E. In some embodiments, the APOBEC1 domain comprises three mutations of W90Y, R126E and R132E.

In some embodiments, one or more mutations in the cytidine deaminase as disclosed herein reduce the editing window width to about 2 nucleotides. In some embodiments, one or more mutations in the cytidine deaminase as disclosed herein reduce the editing window width to about 1 nucleotide. In some embodiments, one or more mutations in the cytidine deaminase as disclosed herein reduce the editing window width while only minimally or modestly affecting the editing efficiency of the enzyme. In some embodiments, one or more mutations in the cytidine deaminase as disclosed herein reduce the editing window width without reducing the editing efficiency of the enzyme. In some embodiments, one or more mutations in the cytidine deaminase as disclosed herein enable discrimination of neighboring cytidine nucleotides, which would be otherwise edited with similar efficiency by the cytidine deaminase.

In some embodiments, the cytidine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the cytidine deaminase and the substrate is mediated by one or more additional protein factor(s), including a CRISPR/CAS protein factor. In some embodiments, the interaction between the cytidine deaminase and the substrate is further mediated by one or more nucleic acid component(s), including a guide RNA.

According to the present invention, the substrate of the cytidine deaminase is an DNA single strand bubble of a RNA duplex comprising a Cytosine of interest, made accessible to the cytidine deaminase upon binding of the guide molecule to its DNA target which then forms the CRISPR-Cas complex with the CRISPR-Cas enzyme, whereby the cytosine deaminase is fused to or is capable of binding to one or more components of the CRISPR-Cas complex, i.e. the CRISPR-Cas enzyme and/or the guide molecule. The particular features of the guide molecule and CRISPR-Cas enzyme are detailed below.

The cytidine deaminase or catalytic domain thereof may be a human, a rat, or a lamprey cytidine deaminase protein or catalytic domain thereof.

The cytidine deaminase protein or catalytic domain thereof may be an apolipoprotein B mRNA-editing complex (APOBEC) family deaminase. The cytidine deaminase protein or catalytic domain thereof may be an activation-induced deaminase (AID). The cytidine deaminase protein or catalytic domain thereof may be a cytidine deaminase 1 (CDA1).

The cytidine deaminase protein or catalytic domain thereof may be an APOBEC1 deaminase. The APOBEC1 deaminase may comprise one or more mutations corresponding to W90A, W90Y, R118A, H121R, H122R, R126A, R126E, or R132E in rat APOBEC1, or an APOBEC3G deaminase comprising one or more mutations corresponding to W285A, W285Y, R313A, D316R, D317R, R320A, R320E, or R326E in human APOBEC3G.

The system may further comprise an uracil glycosylase inhibitor (UGI). Inn some embodiments, the cytidine deaminase protein or catalytic domain thereof is delivered together with a uracil glycosylase inhibitor (UGI). The GI may be linked (e.g., covalently linked) to the cytidine deaminase protein or catalytic domain thereof and/or a catalytically inactive Cas protein.

Base Editing Guide Molecule Design Considerations

In some embodiments, the guide sequence is an RNA sequence of between 10 to 50 nt in length, but more particularly of about 20-30 nt advantageously about 20 nt, 23-25 nt or 24 nt. In base editing embodiments, the guide sequence is selected so as to ensure that it hybridizes to the target sequence comprising the adenosine to be deaminated. This is described more in detail below. Selection can encompass further steps which increase efficacy and specificity of deamination.

In some embodiments, the guide sequence is about 20 nt to about 30 nt long and hybridizes to the target DNA strand to form an almost perfectly matched duplex, except for having a dA-C mismatch at the target adenosine site. Particularly, in some embodiments, the dA-C mismatch is located close to the center of the target sequence (and thus the center of the duplex upon hybridization of the guide sequence to the target sequence), thereby restricting the adenosine deaminase to a narrow editing window (e.g., about 4 bp wide). In some embodiments, the target sequence may comprise more than one target adenosine to be deaminated. In further embodiments the target sequence may further comprise one or more dA-C mismatch 3' to the target adenosine site. In some embodiments, to avoid off-target editing at an unintended Adenine site in the target sequence, the guide sequence can be designed to comprise a non-pairing Guanine at a position corresponding to said unintended Adenine to introduce a dA-G mismatch, which is catalytically unfavorable for certain adenosine deaminases such as ADAR1 and ADAR2. See Wong et al., RNA 7:846-858 (2001), which is incorporated herein by reference in its entirety.

In some embodiments, a Cas guide sequence having a canonical length (e.g., about 20 nt for AacC2c1) is used to form a heteroduplex with the target DNA. In some embodiments, a Cas13b guide molecule longer than the canonical length (e.g., >20 nt for AacC2c1) is used to form a heteroduplex with the target DNA including outside of the Cas-guide RNA-target DNA complex. This can be of interest where deamination of more than one adenine within a given stretch of nucleotides is of interest. In alternative embodiments, it is of interest to maintain the limitation of the canonical guide sequence length. In some embodiments, the guide sequence is designed to introduce a dA-C mismatch outside of the canonical length of Cas guide, which may decrease steric hindrance by Cas and increase the frequency of contact between the adenosine deaminase and the dA-C mismatch.

In some base editing embodiments, the position of the mismatched nucleobase (e.g., cytidine) is calculated from where the PAM would be on a DNA target. In some embodiments, the mismatched nucleobase is positioned 12-21 nt from the PAM, or 13-21 nt from the PAM, or 14-21 nt from the PAM, or 14-20 nt from the PAM, or 15-20 nt from the PAM, or 16-20 nt from the PAM, or 14-19 nt from the PAM, or 15-19 nt from the PAM, or 16-19 nt from the PAM, or 17-19 nt from the PAM, or about 20 nt from the PAM, or about 19 nt from the PAM, or about 18 nt from the PAM, or about 17 nt from the PAM, or about 16 nt from the PAM, or about 15 nt from the PAM, or about 14 nt from the PAM. In a preferred embodiment, the mismatched nucleobase is positioned 17-19 nt or 18 nt from the PAM.

Mismatch distance is the number of bases between the 3' end of the Cas spacer and the mismatched nucleobase (e.g., cytidine), wherein the mismatched base is included as part of the mismatch distance calculation. In some embodiment, the mismatch distance is 1-10 nt, or 1-9 nt, or 1-8 nt, or 2-8 nt, or 2-7 nt, or 2-6 nt, or 3-8 nt, or 3-7 nt, or 3-6 nt, or 3-5 nt, or about 2 nt, or about 3 nt, or about 4 nt, or about 5 nt, or about 6 nt, or about 7 nt, or about 8 nt. In a preferred embodiment, the mismatch distance is 3-5 nt or 4 nt.

In some embodiment, the editing window of a Cas-ADAR system described herein is 12-21 nt from the PAM, or 13-21 nt from the PAM, or 14-21 nt from the PAM, or 14-20 nt from the PAM, or 15-20 nt from the PAM, or 16-20 nt from the PAM, or 14-19 nt from the PAM, or 15-19 nt from the PAM, or 16-19 nt from the PAM, or 17-19 nt from the PAM, or about 20 nt from the PAM, or about 19 nt from the PAM, or about 18 nt from the PAM, or about 17 nt from the PAM, or about 16 nt from the PAM, or about 15 nt from the PAM, or about 14 nt from the PAM. In some embodiment, the editing window of the Cas-ADAR system described herein is 1-10 nt from the 3' end of the Cas spacer, or 1-9 nt from the 3' end of the Cas spacer, or 1-8 nt from the 3' end of the Cas spacer, or 2-8 nt from the 3' end of the Cas spacer, or 2-7 nt from the 3' end of the Cas spacer, or 2-6 nt from the 3' end of the Cas spacer, or 3-8 nt from the 3' end of the Cas spacer, or 3-7 nt from the 3' end of the Cas spacer, or 3-6 nt from the 3' end of the Cas spacer, or 3-5 nt from the 3' end of the Cas spacer, or about 2 nt from the 3' end of the Cas spacer, or about 3 nt from the 3' end of the Cas spacer, or about 4 nt from the 3' end of the Cas spacer, or about 5 nt from the 3' end of the Cas spacer, or about 6 nt from the 3' end of the Cas spacer, or about 7 nt from the 3' end of the Cas spacer, or about 8 nt from the 3' end of the Cas spacer.

Methods for Determining on/Off-Target Activity and Selecting Suitable Target Sequences/Guides In certain example embodiments, parameters such as, but not limited to, off-target candidates, PAM restrictiveness, target cleavage efficiency, or effector protein specific may be determined using sequencing-based double-strand break (DSB) detection assays. Example sequencing-based DSB detection assay sChIP-seq (Szilard et al. Nat. Struct. Mol. Biol. 18, 299-305 (2010); Iacovoni et al. EMBO J. 29, 1446-1457 (2010)), BLESS (Crosetto et al. Nat. Methods 10, 361-365 (2013); Ran etal. Nature 520, 186-191 (2015); Slaymaker et al. Science 351, 84-88 (2016)), GUIDEseq (Tsai et al. Nat. Biotech 33, 187-197 (2015)), Digenome-seq (Kim et al. Nat. Methods 12, 237-43 (2015)), IDLV-mediated DNA break capture (Wang etal. Nat. Biotechnol. 33, 179-186 (2015), HTGTS (Frock etal. Nat. Biotechnol. 33, 179-186 (2015)), End-Seq (Canela etal. Mol. Cell 63, 898-911 (2016), and DSBCapture (Lensing et al. Nat. Methods 13, 855-857 (2016). Additional methods that may be used to assess target cleavage efficiency include SITE-Seq (Cameron et al. Nature Methods, 14, 600-606 (2017), and CIRCLE-seq (Tsai et al. Nature Methods 14, 607-614 (2017)).

Methods useful for assessing Cas RNase activity include those disclosed in Zhong et al. Nature Chemical Biology Jun. 19, 2017 doi: 10.1038/NCHEMBIO.2410. Increased RNase activity and the ability to excise multiple CRISPR RNAs (crRNA) from a single RNA polymerase II-driven RNA transcript can simplify modification of multiple genomic targets and can be used to increase the efficiency of Cas-mediated editing.

Bliss

Other suitable assays include those described in Yan et al. ("BLISS: quantitative and versatile genome-wide profiling of DNA breaks in situ", BioRxiv, Dec. 4, 2016, doi: dx.doi.org/10.1101/091629) describe a versatile, sensitive and quantitative method for detecting DSBs applicable to low-input specimens of both cells and tissues that is scalable for high-throughput DSB mapping in multiple samples. Breaks Labeling In Situ and Sequencing (BLISS), features efficient in situ DSB labeling in fixed cells or tissue sections immobilized onto a solid surface, linear amplification of tagged DSBs via T7-mediated in vitro transcription (IVT) for greater sensitivity, and accurate DSB quantification by incorporation of unique molecular identifiers (UMIs).

Curtain

A further method has been developed which may also be useful in assessing certain parameters disclosed herein. The method allowing on target and off target cutting of a nuclease to be assessed in a direct and unbiased way using in vitro cutting of immobilized nucleic acid molecules. Further reference is made to International Patent Application No. PCT/US2017/028009 entitled "Unbiased Detection of Nucleic Acid Modifictions" filed on Jun. 16, 2017.

This method may also be used to select a suitable guide RNA. The method allows the detection of a nucleic acid modification, by performing the following steps: i) contacting one or more nucleic acid molecules immobilized on a solid support (immobilized nucleic acid molecules) with an agent capable of inducing a nucleic acid modification; and ii) sequencing at least part of said one or more immobilized nucleic acid molecules that comprises the nucleic acid modification using a primer specifically binding to a primer binding site. This method further allows the selection of a guide RNA from a plurality of guide RNAs specific for a selected target sequence. In particular embodiments, the method comprises contacting a plurality of nucleic acid molecules immobilized on a solid support (immobilized nucleic acid molecules) with a plurality of RNA-guided nuclease complexes capable of inducing a nucleic acid break, said plurality of RNA-guided nuclease complexes comprising a plurality of different guide RNA's, thereby inducing one or more nucleic acid breaks; attaching an adapter comprising a primer binding site to said one or more immobilized nucleic acid molecules comprising a nucleic acid break; sequencing at least part of said one or more immobilized nucleic acid molecules comprising a nucleic acid break using a primer specifically binding to said primer binding site; and selecting a guide RNA based on location and/or amount of said one or more breaks.

In particular embodiments, the method comprises determining one or more locations in said one or more immobilized nucleic acid molecules comprising a break other than a location comprising said selected target sequence (off-target breaks) and selecting a guide RNA based on said one or more locations. In particular embodiments, step v comprises determining a number of sites in said one or more immobilized nucleic acid molecules comprising off-target breaks and selecting a guide RNA based on said number of sites. In a further embodiment, step iv comprises both determining the location of off-targets breaks and the number of locations of off-target breaks.

Safety

1. Select Protein with Shortest Half-Life a) Inherent Half-Life of the Effector Protein The extended presence of an effector protein after having performed its function at the target site is a potential safety concern, both for off-target effects and direct toxicity of the effector protein. It has been reported that upon direct delivery to the cell by LNP, CRISPR effector proteins degrade rapidly within the cell (Kim et al. Genome Res. 2014 June; 24(6): 1012-1019). Where the effector protein is to be expressed from a plasmid, strategies to actively reduce the half-life of the protein may be of interest.

b) Use of Destabilized Domains

In certain embodiments, the methods provided herein involve the use of a Cas effector protein which is associated with or fused to a destabilization domain (DD). The technology relating to the use of destabilizing domains is described in detail in WO2016/106244, which is incorporated by reference herein.

Destabilizing domains (DD) are domains which can confer instability to a wide range of proteins; see, e.g., Miyazaki, J Am Chem Soc. Mar. 7, 2012; 134(9): 3942-3945, and Chung H Nature Chemical Biology Vol. 11 Sep. 2015 pgs 713-720, incorporated herein by reference. DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the Cas effector to be regulated or controlled, thereby providing means for regulation or control of the system. For instance, when a protein of interest is expressed as a fusion with the DD tag, it is destabilized and rapidly degraded in the cell, e.g., by proteasomes. Thus, absence of stabilizing ligand leads to a DD-associated Cas being degraded. Peak activity of the Cas effector is relevant to reduce off-target effects and for the general safety of the system. Advantages of the DD system include that it can be dosable, orthogonal (e.g., a ligand only affects its cognate DD so two or more systems can operate independently), transportable (e.g., may work in different cell types or cell lines) and allows for temporal control.

Suitable DD—stabilizing ligand pairs are known in the art and also described in WO2016/106244. The size of Destabilization Domain varies but is typically approx.—approx. 100-300 amino acids in size. Suitable examples include ER50 and/or DHFR50. A corresponding stabilizing ligand for ER50 is, for example, 4HT or CMP8. In some embodiments, one or two DDs may be fused to the N-terminal end of the CRISPR enzyme with one or two DDs fused to the C-terminal of the CRISPR enzyme. While the DD can be provided directly at N and/or C terminal(s) of the Cas effector protein, they can also be fused via a linker, such as a GlySer linker, or an NLS and/or NES. A commercially available DD system is the CloneTech, ProteoTuner™ system; the stabilizing ligand is Shield1. In some embodiments, the stabilizing ligand is a 'small molecule', preferably it is cell-permeable and has a high affinity for its corresponding DD.

2. Select Least Immunogenic RNP

When administering an agent to a mammal, there is always the risk of an immune response to the agent and/or its delivery vehicle. Circumventing the immune response is a major challenge for most delivery vehicles. Viral vectors, which express immunogenic epitopes within the organism typically induce an immune response. Nanoparticle and lipid-based vectors to some extent address this problem. Yin et al. demonstrate a therapeutic approach combining viral delivery of the guide RNA with lipid nanoparticle-mediated delivery of the CRISPR effector protein (Nature Biotechnology 34:328-33(2016)). Ziris et al. describes cationin-lipid mediated delivery of Cas9:guideRNA nuclease complexes to cells. The CRISPR effector proteins, which are of bacterial origin, also inherently carry the risk of eliciting an immune response. This may be addressed by humanizing the Cas effector protein.

3. Introduce Modifications in Guide RNA to Minimize Immunogenicity

Chemical modifications of RNAs have been used to avoid reactions of the innate immune system. Judge et al. (2006) demonstrated that immune stimulation by synthetic siRNA can be completely abrogated by selective incorporation of 2'-O-methyl (2'OMe) uridine or guanosine nucleosides into one strand of the siRNA duplex (Mol. Ther., 13 (2006), pp. 494-505). Cekaite et al. (J. Mol. Biol., 365 (2007), pp. 90-108) observed that replacement of only uridine bases of siRNA with either 2'-fluoro or 2'-O-methyl modified counterparts abrogated upregulation of genes involved in the regulation of the immune response. Similarly Hendel et al. tested sgRNAs with both backbone and sugar modifications that confer nuclease stability and can reduce immunostimulatory effects (Hendel et al., Nat. Biotechnol., 33 (2015), pp. 985-989).

Accordingly, in particular embodiments, the methods comprise modifying the guide RNA so as to minimize immunogenicity using one or more of these methods.

Identify Optimal Dosage to Minimize Toxicity and Maximize Specificity

It is generally accepted that the dosage of CRISPR components will be relevant to toxicity and specificity of the system (Pattanayak et al. Nat Biotechnol. 2013 September; 31(9): 839-843). Hsu et al. (Nat Biotechnol. 2013 September; 31(9): 827-832) demonstrated that the dosage of SpCas9 and sgRNA can be titrated to address these issues. In certain example embodiments, toxicity is minimized by saturating complex with guide by either pre-forming complex, putting guide under control of a strong promoter, or via timing of delivery to ensure saturating conditions available during expression of the effector protein.

Identifying Appropriate Delivery Vector

In some embodiments, the components of the CRISPR system may be delivered in various form, such as combinations of DNA/RNA or RNA/RNA or protein/RNA. For example, the Cas may be delivered as a DNA-coding polynucleotide or an RNA—coding polynucleotide or as a protein. The guide may be delivered as a DNA-coding polynucleotide or an RNA. All possible combinations are envisioned, including mixed forms of delivery.

In some aspects, the invention provides methods comprising delivering one or more polynucleotides, such as or one or more vectors as described herein, one or more transcripts thereof, and/or one or proteins transcribed therefrom, to a host cell.

Delivery

Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

Plasmids and Vectors

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

Plasmid delivery involves the cloning of a guide RNA into a CRISPR effector protein expressing plasmid and transfecting the DNA in cell culture. Plasmid backbones are available commercially and no specific equipment is required. They have the advantage of being modular, capable of carrying different sizes of CRISPR effector coding sequences (including those encoding larger sized proteins) as well as selection markers. An advantage of plasmids is that they can ensure transient, but sustained expression. However, delivery of plasmids is not straightforward such that in vivo efficiency is often low. The sustained expression can also be disadvantageous in that it can increase off-target editing. In addition excess build-up of the CRISPR effector protein can be toxic to the cells. Finally, plasmids always hold the risk of random integration of the dsDNA in the host genome, more particularly in view of the double-stranded breaks being generated (on and off-target).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389-832 (1994); Remy et al., Bioconjugate Chem. 5:647-654-832(1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787). This is discussed more in detail below.

The advantages and disadvantages of Plasmid delivery are described by Plasmid delivery involves the cloning of a guide RNA into a CRISPR effector protein expressing plasmid and transfecting the DNA in cell culture. Plasmid backbones are available commercially and no specific equipment is required. They have the advantage of being modular, capable of carrying different sizes of CRISPR effector coding sequences (including those encoding larger sized proteins) as well as selection markers. An advantage of plasmids is that they can ensure transient, but sustained expression. However, delivery of plasmids is not straightforward such that in vivo efficiency is often low. The sustained expression can also be disadvantageous in that it can increase off-target editing. In addition excess build-up of the CRISPR effector protein can be toxic to the cells. Finally, plasmids always hold the risk of random integration of the dsDNA in the host genome, more particularly in view of the double-stranded breaks being generated (on and off-target) .The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389b832 (1994); Remy et al., Bioconjugate Chem. 5:647-654b832 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787). This is discussed more in detail below.

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

The invention provides AAV that contains or consists essentially of an exogenous nucleic acid molecule encoding a CRISPR system, e.g., a plurality of cassettes comprising or consisting a first cassette comprising or consisting essentially of a promoter, a nucleic acid molecule encoding a CRISPR-associated (Cas) protein (putative nuclease or helicase proteins), e.g., Cas9 and a terminator, and a two, or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator (where N is a number that can be inserted that is at an upper limit of the packaging size limit of the vector), or two or more individual rAAVs, each containing one or more than one cassette of a CRISPR system, e.g., a first rAAV containing the first cassette comprising or consisting essentially of a promoter, a nucleic acid molecule encoding Cas, e.g., Cas9 and a terminator, and a second rAAV containing a plurality, four, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator (where N is a number that can be inserted that is at an upper limit of the packaging size limit of the vector). As rAAV is a DNA virus, the nucleic acid molecules in the herein discussion concerning AAV or rAAV are advantageously DNA. The promoter is in some embodiments advantageously human Synapsin I promoter (hSyn). In another embodiment, multiple gRNA expression cassettes along with the Cas9 expression cassette can be delivered in a high-capacity adenoviral vector (HCAdV), from which all AAV coding genes have been removed. See e.g, Schiwon et al., "One-Vector System for Multiplexed CRISPR/Cas9 against Hepatitis B Virus cccDNA Utilizing High-Capacity Adenoviral Vectors" Mol Ther Nucleic Acids. 2018 Sep. 7; 12: 242-253; and Ehrke-Schulz et al., "CRISPR/Cas9 delivery with one single adenoviral vector devoid of all viral genes" Sci Rep. 2017; 7: 17113. Additional methods for the delivery of nucleic acids to cells are known to those skilled in the art. See, for example, US20030087817, incorporated herein by reference.

Also contemplated is delivery by dual vector systems. In one embodiment, expression cassettes of Cas9 and gRNA can be delivered via a dual vector system. Such systems can include, for example, a first AAV vector encoding a gRNA and an N-terminal Cas9 and a second AAV vector containing a C-terminal Cas9. See, e.g. Moreno et al., "In Situ Gene Therapy via AAV—CRISPR-Cas9-Mediated Targeted Gene Regulation" Mol Ther. 2018 Jul. 5; 26(7):1818-1827. In another embodiment, Cas9 protein can be separated into two parts that are expressed individually and reunited in the cell by various means, including use of 1) the gRNA as a scaffold for Cas9 assembly; 2) the rapamycin-controlled FKBP/FRB system; 3) the light-regulated Magnet system; or 4) inteins. See, e.g. Schmelas et al., "Split Cas9, Not Hairs—Advancing the Therapeutic Index of CRISPR Technology" Biotechnol J. 2018 September;13(9):e1700432. doi: 10.1002/biot.201700432. Epub 2018 Feb. 2.

In some embodiments, an AAV vector can include additional sequence information encoding sequences that facilitate transduction or that assist in evasion of the host immune system. In one embodiment, CRISPR-Cas9 can be delivered to astrocytes using an AAV vector that includes a synthetic surface peptide for transduction of astrocytes. See, e.g. Kunze et al., "Synthetic AAV/CRISPR vectors for blocking HIV-1 expression in persistently infected astrocytes" Glia. 2018 February;66(2):413-427. In another embodiment, CRISPR-Cas9 can be delivered in a capsid engineered AAV, for example an AAV that has been engineered to include "chemical handles" on the AAV surface and be complexed with lipids to produce a "cloaked AAV" that is resistant to endogenous neutralizing antibodies in the host. See, e.g. Katrekar et al., "Oligonucleotide conjugated multi-functional adeno-associated viruses" Sci Rep. 2018; 8: 3589.

In another embodiment, Cocal vesiculovirus envelope pseudotyped retroviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. Within certain aspects of these embodiments, the Gag, Pol, and accessory proteins are lentiviral and/or gammaretroviral.

In some embodiments, a host cell is transiently or non-transiently transfected with one or more vectors described herein. In some embodiments, a cell is transfected as it naturally occurs in a subject optionally to be reintroduced therein. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DUi45, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-iA, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-iA/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

Vectors

In general, and throughout this specification, the term "vector" refers to a nucleic acid molecule capable of transporting another nucleic acid to which it has been linked. It is a replicon, such as a plasmid, phage, or cosmid, into which another DNA segment may be inserted so as to bring about the replication of the inserted segment. Generally, a vector is capable of replication when associated with the proper control elements.

Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include lentiviruses and adeno-associated viruses, and types of such vectors can also be selected for targeting particular types of cells.

With regards to recombination and cloning methods, mention is made of U.S. patent application Ser. No. 10/815, 730, published Sep. 2, 2004 as US 2004-0171156 A1, the contents of which are herein incorporated by reference in their entirety.

Advantageous vectors include lentiviruses and adeno-associated viruses, and types of such vectors can also be selected for targeting particular types of cells.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector proteins or has cells containing nucleic acid-targeting effector proteins, such as by way of prior administration thereto of a vector or vectors that code for and express in vivo nucleic acid-targeting effector proteins. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a nucleic acid-targeting effector protein. Nucleic acid-targeting effector protein or nucleic acid-targeting guide RNA or RNA(s) can be delivered separately; and advantageously at least one of these is delivered via a particle complex. nucleic acid-targeting effector protein mRNA can be delivered prior to the nucleic acid-targeting guide RNA to give time for nucleic acid-targeting effector protein to be expressed. Nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+ guide RNA. Additional administrations of nucleic acid-targeting effector protein mRNA and/or guide RNA might be useful to achieve the most efficient levels of genome modification.

In some embodiments, a vector encodes a Cas effector protein comprising one or more nuclear localization sequences (NLSs), such as about or more than about 1, 2, 3, 4, 5, 6, 7, 8, 9, 10, or more NLSs. More particularly, vector comprises one or more NLSs not naturally present in the Cas effector protein. Most particularly, the NLS is present in the vector 5' and/or 3' of the Cas effector protein sequence In some embodiments, the RNA-targeting effector protein comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 178); the NLS from nucleoplasmin (e.g., the nucleoplasmin bipartite NLS with the sequence KRPAATKKAGQAKKKK (SEQ ID NO: 179));

the c-myc NLS having the amino acid sequence PAAKRVKLD (SEQ ID NO: 180) or RQRRNELKRSP (SEQ ID NO: 181); the hRNPA1 M9 NLS having the sequence NQSSNFGPMKGGNFG-GRSSGPYGGGGQYFAKPRNQGGY (SEQ ID NO: 182); the sequence RMRIZFKNKGKDTAELRRRRVEVS-VELRKAKKDEQILKRRNV (SEQ ID NO: 183) of the IBB domain from importin-alpha; the sequences VSRKRPRP (SEQ ID NO: 184) and PPKKARED (SEQ ID NO: 185) of the myoma T protein; the sequence PQPKKKPL (SEQ ID NO: 186) of human p53; the sequence SALIKKKKKMAP (SEQ ID NO: 187) of mouse c-abl IV; the sequences DRLRR (SEQ ID NO: 188) and PKQKKRK (SEQ ID NO: 189) of the influenza virus NS1; the sequence RKLKK-KIKKL (SEQ ID NO: 190) of the Hepatitis virus delta antigen; the sequence REKKKFLKRR (SEQ ID NO: 191) of the mouse Mx1 protein; the sequence KRKGDEVDGVDEVAKKKSKK (SEQ ID NO: 192) of the human poly(ADP-ribose) polymerase; and the sequence RKCLQAGMNLEARKTKK (SEQ ID NO: 193) of the steroid hormone receptors (human) glucocorticoid. In general, the one or more NLSs are of sufficient strength to drive accumulation of the DNA/RNA-targeting Cas protein in a detectable amount in the nucleus of a eukaryotic cell. In general, strength of nuclear localization activity may derive from the number of NLSs in the nucleic acid-targeting effector protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immuno-histochemistry, Western blot, or enzyme activity assay. Accumulation in the nucleus may also be determined indirectly, such as by an assay for the effect of nucleic acid-targeting complex formation (e.g., assay for DNA or RNA cleavage or mutation at the target sequence, or assay for altered gene expression activity affected by DNA or RNA-targeting complex formation and/or DNA or RNA-targeting Cas protein activity), as compared to a control not exposed to the nucleic acid-targeting Cas protein or nucleic acid-targeting complex, or exposed to a nucleic acid-targeting Cas protein lacking the one or more NLSs. In preferred embodiments of the herein described Cas effector protein complexes and systems the codon optimized Cas effector proteins comprise an NLS attached to the C-terminal of the protein. In certain embodiments, other localization tags may be fused to the Cas protein, such as without limitation for localizing the Cas to particular sites in a cell, such as organelles, such mitochondria, plastids, chloroplast, vesicles, Golgi, (nuclear or cellular) membranes, ribosomes, nucleolus, ER, cytoskeleton, vacuoles, centrosome, nucleosome, granules, centrioles, etc.

The invention also provides a non-naturally occurring or engineered composition, or one or more polynucleotides encoding components of said composition, or vector systems comprising one or more polynucleotides encoding components of said composition for use in a therapeutic method of treatment. The therapeutic method of treatment may comprise gene or genome editing, or gene therapy.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

In certain embodiments, a vector system includes promoter-guide expression cassette in reverse order.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed.

Advantageous vectors include lentiviruses and adeno-associated viruses, and types of such vectors can also be selected for targeting particular types of cells.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector module and a nucleic acid-targeting guide RNA could each be operably linked to separate regulatory elements on separate vectors. RNA(s) of the nucleic acid-targeting system can be delivered to a transgenic nucleic acid-targeting effector module animal or mammal, e.g., an animal or mammal that constitutively or inducibly or conditionally expresses nucleic acid-targeting effector module; or an animal or mammal that is otherwise expressing nucleic acid-targeting effector modules or has cells containing nucleic acid-targeting effector modules, such as by way of prior administration thereto of a vector or vectors that code for and express in vivo nucleic acid-targeting effector modules. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector module and the nucleic acid-targeting guide RNA, embedded within one or more intron sequences (e.g., each in a different intron, two or more in at least one intron, or all in a single intron). In some embodiments, the nucleic acid-targeting effector module and the nucleic acid-targeting guide RNA may be operably linked to and expressed from the same promoter.

In an aspect, the invention provides in a vector system comprising one or more vectors, wherein the one or more vectors comprises: a) a first regulatory element operably linked to a nucleotide sequence encoding the engineered CRISPR protein as defined herein; and optionally b) a second regulatory element operably linked to one or more nucleotide sequences encoding one or more nucleic acid molecules comprising a guide RNA comprising a guide sequence, a direct repeat sequence optionally wherein components (a) and (b) are located on same or different vectors.

RNA

In some embodiments it is envisaged to introduce the RNA and/or protein directly to the host cell. For instance, the CRISPR effector can be delivered as CRISPR effector-encoding mRNA together with an in vitro transcribed guide RNA. Such methods can reduce the time to ensure effect of the CRISPR effector protein and further prevents long-term expression of the CRISPR system components.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver Cas and gRNA (and, for instance, HR repair template) into cells using liposomes or nanoparticles. Thus delivery of the CRISPR enzyme, such as a Cas and/or delivery of the RNAs of the invention may be in RNA form and via microvesicles, liposomes or particle or particles. For example, Cas mRNA and gRNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E ($\alpha$-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free Tocsi-BACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to $\alpha$-tocopherol and co-administered with HDL targeted to the brain may be contemplated for humans in the present invention, for example, about 3 nmol to about 3 pmol of CRISPR Cas targeted to the brain may be contemplated. Zou et al. ((HUMAN GENE THERAPY 22:465-475 (April 2011)) describes a method of lentiviral-mediated delivery of short-hairpin RNAs targeting PKC7 for in vivo gene silencing in the spinal cord of rats. Zou et al. administered about 10 µl of a recombinant lentivirus having a titer of $1\times10^9$ transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1\times10^9$ transducing units (TU)/ml may be contemplated.

Vector delivery, e.g., plasmid, viral delivery: The CRISPR enzyme, for instance a Cas, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Cas and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

Viruses

Among vectors that may be used in the practice of the invention, integration in the host genome of a cell is possible with retrovirus gene transfer methods, often resulting in long term expression of the inserted transgene. In a preferred embodiment the retrovirus is a lentivirus. Additionally, high transduction efficiencies have been observed in many different cell types and target tissues. The tropism of a retrovirus can be altered by incorporating foreign envelope proteins, expanding the potential target population of target cells. A retrovirus can also be engineered to allow for conditional expression of the inserted transgene, such that only certain cell types are infected by the lentivirus. Cell type specific promoters can be used to target expression in specific cell types. Lentiviral vectors are retroviral vectors (and hence both lentiviral and retroviral vectors may be used in the practice of the invention). Moreover, lentiviral vectors are preferred as they are able to transduce or infect non-dividing cells and typically produce high viral titers. Selection of a retroviral gene transfer system may therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the desired nucleic acid into the target cell to provide permanent expression. Widely used retroviral vectors that may be used in the practice of the invention include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., (1992) J. Virol. 66:2731-2739; Johann et al., (1992) J. Virol. 66:1635-1640; Sommnerfelt et al., (1990) Virol. 176:58-59; Wilson et al., (1998) J. Virol. 63:2374-2378; Miller et al., (1991) J. Virol. 65:2220-2224; PCT/US94/05700). Zou et al. administered about 10 µl of a recombinant lentivirus having a titer of 1×109 transducing units (TU)/ml by an intrathecal catheter. These sort of dosages can be adapted or extrapolated to use of a retroviral or lentiviral vector in the present invention.

Vector Packaging of CRISPR Proteins

Ways to package inventive Cas coding nucleic acid molecules, e.g., DNA, into vectors, e.g., viral vectors, to mediate genome modification in vivo include:

To achieve NHEJ-mediated gene knockout:
Single virus vector:
Vector containing two or more expression cassettes:
Promoter-Cas coding nucleic acid molecule-terminator
Promoter-gRNA1-terminator
Promoter-gRNA2-terminator
Promoter-gRNA(N)-terminator (up to size limit of vector)
Double virus vector:
Vector 1 containing one expression cassette for driving the expression of Cas
Promoter-Cas coding nucleic acid molecule-terminator
Vector 2 containing one more expression cassettes for driving the expression of one or more guideRNAs
Promoter-gRNA1-terminator
Promoter-gRNA(N)-terminator (up to size limit of vector)
To mediate homology-directed repair.
In addition to the single and double virus vector approaches described above, an additional vector can be used to deliver a homology-direct repair template.

The promoter used to drive Cas coding nucleic acid molecule expression can include:
AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of Cas.
For ubiquitous expression, promoters that can be used include: CMV, CAG, CBh, PGK, SV40, Ferritin heavy or light chains, etc.
For brain or other CNS expression, can use promoters: SynapsinI for all neurons, CaMKIIalpha for excitatory neurons, GAD67 or GAD65 or VGAT for GABAergic neurons, etc.
For liver expression, can use Albumin promoter.
For lung expression, can use SP-B.
For endothelial cells, can use ICAM.
For hematopoietic cells can use IFNbeta or CD45.
For Osteoblasts can one can use the OG-2.
The promoter used to drive guide RNA can include:
Pol III promoters such as U6 or H1
Use of Pol II promoter and intronic cassettes to express gRNA Adeno Associated Virus (AAV)

Cas and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat.

No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of Cas can be driven by a cell-type specific promoter. For example, liver-specific expression might use the Albumin promoter and neuron-specific expression (e.g. for targeting CNS disorders) might use the Synapsin I promoter.

In terms of in vivo delivery, AAV is advantageous over other viral vectors for a couple of reasons:

Low toxicity (this may be due to the purification method not requiring ultra centrifugation of cell particles that can activate the immune response) and Low probability of causing insertional mutagenesis because it doesn't integrate into the host genome.

AAV has a packaging limit of 4.5 or 4.75 Kb. This means that Cas as well as a promoter and transcription terminator have to be all fit into the same viral vector. Constructs larger than 4.5 or 4.75 Kb will lead to significantly reduced virus production. SpCas9 is quite large, the gene itself is over 4.1 Kb, which makes it difficult for packing into AAV. Therefore embodiments of the invention include utilizing homologs of Cas that are shorter. For example:

| Species | Cas9 Size (nt) |
| --- | --- |
| Corynebacter diphtheriae | 3252 |
| Eubacterium ventriosum | 3321 |
| Streptococcus pasteurianus | 3390 |
| Lactobacillus farciminis | 3378 |
| Sphaerochaeta globus | 3537 |
| Azospirillum B510 | 3504 |
| Gluconacetobacter diazotrophicus | 3150 |

-continued

| Species | Cas9 Size (nt) |
| --- | --- |
| Neisseria cinerea | 3246 |
| Roseburia intestinalis | 3420 |
| Parvibaculum lavamentivorans | 3111 |
| Staphylococcus aureus | 3159 |
| Nitratifractor salsuginis DSM 16511 | 3396 |
| Campylobacter lari CF 89-12 | 3009 |
| Campylobacter jejuni | 2952 |
| Streptococcus thermophilus LMD-9 | 3396 | rAAV vectors are preferably produced in insect cells, e.g., Spodoptera frugiperda Sf9 insect cells, grown in serum-free suspension culture. Serum-free insect cells can be purchased from commercial vendors, e.g., Sigma Aldrich (EX-CELL 405).

These species are therefore, in general, preferred Cas species.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
| --- | --- | --- | --- | --- | --- | --- | --- | --- |
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection was done in 4 mL OptiMEM with a cationic lipid delivery agent (50 uL Lipofectamine 2000 and 100ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50ul of DMEM overnight at 4C. They were then aliquoted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the CRISPR-Cas system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CRISPR-Cas system of the present invention. A minimum of 2.5×106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (Cell-Genix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin,Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

Use of Minimal Promoters

The present application provides a vector for delivering an effector protein and at least one CRISPR guide RNA to a cell comprising a minimal promoter operably linked to a polynucleotide sequence encoding the effector protein and a second minimal promoter operably linked to a polynucleotide sequence encoding at least one guide RNA, wherein the length of the vector sequence comprising the minimal promoters and polynucleotide sequences is less than 4.4 Kb. In an embodiment, the vector is an AAV vector. In another embodiment, the effector protein is a CRISPR enzyme. In a further embodiment, the CRISPR enzyme is SaCas9, Cpf1, Cas13b or C2c2.

In a related aspect, the invention provides a lentiviral vector for delivering an effector protein and at least one CRISPR guide RNA to a cell comprising a promoter operably linked to a polynucleotide sequence encoding Cas and a second promoter operably linked to a polynucleotide sequence encoding at least one guide RNA, wherein the polynucleotide sequences are in reverse orientation.

In another aspect, the invention provides a method of expressing an effector protein and guide RNA in a cell comprising introducing the vector according any of the vector delivery systems disclosed herein. In an embodiment of the vector for delivering an effector protein, the minimal promoter is the Mecp2 promoter, tRNA promoter, or U6. In a further embodiment, the minimal promoter is tissue specific.

Dosage of Vectors

In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1 \times 10^5$ particles (also referred to as particle units, pu) of adenoviral vector. In an embodiment herein, the dose preferably is at least about $1 \times 10^6$ particles (for example, about $1 \times 10^6$-$1 \times 10^{12}$ particles), more preferably at least about $1 \times 10^7$ particles, more preferably at least about $1 \times 10^8$ particles (e.g., about $1 \times 10^8$-$1 \times 10^{11}$ particles or about $1 \times 10^8$-$1 \times 10^{12}$ particles), and most preferably at least about $1 \times 10^0$ particles (e.g., about $1 \times 10^9$-$1 \times 10^{10}$ particles or about $1 \times 10^9$-$1 \times 10^{12}$ particles), or even at least about $1 \times 10^{10}$ particles (e.g., about $1 \times 10^{10}$-$1 \times 10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^{9}$ articles). Thus, the dose may contain a single dose of adenoviral vector with, for example, about $1\times10^{6}$ particle units (pu), about $2\times10^{6}$ pu, about $4\times10^{6}$ pu, about $1\times10^{7}$ pu, about $2\times10^{7}$ pu, about $4\times10^{7}$ pu, about $1\times10^{8}$ pu, about $2\times10^{8}$ pu, about $4\times10^{8}$ pu, about $1\times10^{11}$ pu, about $2\times10^{8}$ pu, about $4\times10^{8}$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^{5}$ to $1\times10^{50}$ genomes AAV, from about $1\times10^{8}$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{10}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 g to about g per 70 kg individual. Plasmids of the invention will generally comprise (i) a promoter; (ii) a sequence encoding a CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

The dosage used for the compositions provided herein include dosages for repeated administration or repeat dosing. In particular embodiments, the administration is repeated within a period of several weeks, months, or years. Suitable assays can be performed to obtain an optimal dosage regime. Repeated administration can allow the use of a lower dosage, which can positively affect off-target modifications.

RNA Delivery

In particular embodiments, RNA based delivery is used. In these embodiments, mRNA of the CRISPR effector protein is delivered together with in vitro transcribed guide RNA. Liang et al. describes efficient genome editing using RNA based delivery (Protein Cell. 2015 May; 6(5): 363-372).

RNA delivery: The CRISPR enzyme, for instance a Cas, and/or any of the present RNAs, for instance a guide RNA, can also be delivered in the form of RNA. Cas mRNA can be generated using in vitro transcription. For example, Cas mRNA can be synthesized using a PCR cassette containing the following elements: T7_promoter-kozak sequence (GC-CACC)-Cas-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the CRISPR enzyme-coding sequence and/or the guide RNA can be modified to include one or more modified nucleoside e.g. using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

CRISPR enzyme mRNA and guide RNA might also be delivered separately. CRISPR enzyme mRNA can be delivered prior to the guide RNA to give time for CRISPR enzyme to be expressed. CRISPR enzyme mRNA might be administered 1-12 hours (preferably around 2-6 hours) prior to the administration of guide RNA.

Alternatively, CRISPR enzyme mRNA and guide RNA can be administered together.

Advantageously, a second booster dose of guide RNA can be administered 1-12 hours (preferably around 2-6 hours) after the initial administration of CRISPR enzyme mRNA+ guide RNA. RNP In particular embodiments, pre-complexed guide RNA and CRISPR effector protein are delivered as a ribonucleoprotein (RNP). RNPs have the advantage that they lead to rapid editing effects even more so than the RNA method because this process avoids the need for transcription. An important advantage is that both RNP delivery is transient, reducing off-target effects and toxicity issues. Efficient genome editing in different cell types has been observed by Kim et al. (2014, Genome Res. 24(6):1012-9), Paix et al. (2015, Genetics 204(1):47-54), Chu et al. (2016, BMC Biotechnol. 16:4), and Wang et al. (2013, Cell. 9;153(4): 910-8).

In particular embodiments, the ribonucleoprotein is delivered by way of a polypeptide-based shuttle agent as described in WO2016161516. WO2016161516 describes efficient transduction of polypeptide cargos using synthetic peptides comprising an endosome leakage domain (ELD) operably linked to a cell penetrating domain (CPD), to a histidine-rich domain and a CPD. Similarly these polypeptides can be used for the delivery of CRISPR-effector based RNPs in eukaryotic cells.

Indeed, RNA delivery is a useful method of in vivo delivery. It is possible to deliver Cas and gRNA (and, for instance, HR repair template) into cells using liposomes or particles. Thus delivery of the CRISPR enzyme, such as a Cas and/or delivery of the RNAs of the invention may be in RNA form and via microvesicles, liposomes or particles. For example, Cas mRNA and gRNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free Tocsi-BACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 pmol of CRISPR Cas targeted to the brain may be contemplated.

Zou et al. ((HUMAN GENE THERAPY 22:465-475 (April 2011)) describes a method of lentiviral-mediated delivery of short-hairpin RNAs targeting PKC7 for in vivo gene silencing in the spinal cord of rats. Zou et al. administered about 10 µl of a recombinant lentivirus having a titer of $1\times10^9$ transducing units (TU)/ml by an intrathecal catheter. A similar dosage of CRISPR Cas expressed in a lentiviral vector may be contemplated for humans in the present invention, for example, about 10-50 ml of CRISPR Cas in a lentivirus having a titer of $1\times10^9$ transducing units (TU)/ml may be contemplated. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1\times10^9$ transducing units (TU)/ml may be contemplated.

Anderson et al. (US 20170079916) provides a modified dendrimer nanoparticle for the delivery of therapeutic, prophylactic and/or diagnostic agents to a subject, comprising: one or more zero to seven generation alkylated dendrimers; one or more amphiphilic polymers; and one or more therapeutic, prophylactic and/or diagnostic agents encapsulated therein. One alkylated dendrimer may be selected from the group consisting of poly(ethyleneimine), poly(polyproylenimine), diaminobutane amine polypropylenimine tetramine and poly(amido amine). The therapeutic, prophylactic and diagnostic agent may be selected from the group consisting of proteins, peptides, carbohydrates, nucleic acids, lipids, small molecules and combinations thereof.

Anderson et al. (US 20160367686) provides a compound of Formula (I):

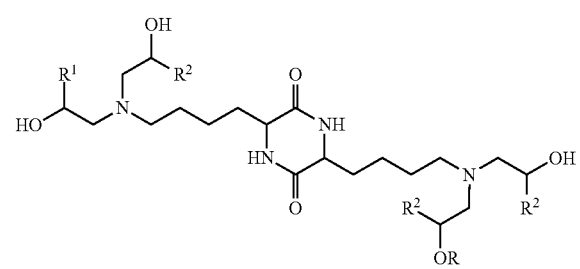

and salts thereof, wherein each instance of R L is independently optionally substituted C6-C40 alkenyl, and a composition for the delivery of an agent to a subject or cell comprising the compound, or a salt thereof, an agent; and optionally, an excipient. The agent may be an organic molecule, inorganic molecule, nucleic acid, protein, peptide, polynucleotide, targeting agent, an isotopically labeled chemical compound, vaccine, an immunological agent, or an agent useful in bioprocessing. The composition may further comprise cholesterol, a PEGylated lipid, a phospholipid, or an apolipoprotein.

Anderson et al. (US20150232883) provides a delivery particle formulations and/or systems, preferably nanoparticle delivery formulations and/or systems, comprising (a) a CRISPR-Cas system RNA polynucleotide sequence; or (b) Cas9; or (c) both a CRISPR-Cas system RNA polynucleotide sequence and Cas9; or (d) one or more vectors that contain nucleic acid molecule(s) encoding (a), (b) or (c), wherein the CRISPR-Cas system RNA polynucleotide sequence and the Cas9 do not naturally occur together. The delivery particle formulations may further comprise a surfactant, lipid or protein, wherein the surfactant may comprise a cationic lipid.

Anderson et al. (US20050123596) provides examples of microparticles that are designed to release their payload when exposed to acidic conditions, wherein the microparticles comprise at least one agent to be delivered, a pH triggering agent, and a polymer, wherein the polymer is selected from the group of polymethacrylates and polyacrylates.

Anderson et al (US 20020150626) provides lipid-protein-sugar particles for delivery of nucleic acids, wherein the polynucleotide is encapsulated in a lipid-protein-sugar matrix by contacting the polynucleotide with a lipid, a protein, and a sugar; and spray drying mixture of the polynucleotide, the lipid, the protein, and the sugar to make microparticles.

In terms of local delivery to the brain, this can be achieved in various ways. For instance, material can be delivered intrastriatally e.g. by injection. Injection can be performed stereotactically via a craniotomy.

Enhancing NHEJ or HR efficiency is also helpful for delivery. It is preferred that NHEJ efficiency is enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

Particles

In some aspects or embodiments, a composition comprising a delivery particle formulation may be used. In some aspects or embodiments, the formulation comprises a CRISPR complex, the complex comprising a CRISPR protein and-a guide which directs sequence-specific binding of the CRISPR complex to a target sequence. In some embodiments, the delivery particle comprises a lipid-based particle, optionally a lipid nanoparticle, or cationic lipid and optionally biodegradable polymer. In some embodiments, the cationic lipid comprises 1,2-dioleoyl-3-trimethylammonium-propane (DOTAP). In some embodiments, the hydrophilic polymer comprises ethylene glycol or polyethylene glycol. In some embodiments, the delivery particle further comprises a lipoprotein, preferably cholesterol. In some embodiments, the delivery particles are less than 500 nm in diameter, optionally less than 250 nm in diameter, optionally less than 100 nm in diameter, optionally about 35 nm to about 60 nm in diameter.

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

In terms of this invention, it is preferred to have one or more components of CRISPR complex, e.g., CRISPR enzyme or mRNA or guide RNA delivered using nanoparticles or lipid envelopes. Other delivery systems or vectors may be used in conjunction with the nanoparticle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, nanoparticles of the invention have a greatest dimension of 100 nm or less. In other preferred embodiments, nanoparticles of the invention have a greatest dimension ranging between 35 nm and 60 nm. It will be appreciated that reference made herein to particles or nanoparticles can be interchangeable, where appropriate.

It will be understood that the size of the particle will differ depending as to whether it is measured before or after loading. Accordingly, in particular embodiments, the term "nanoparticles" may apply only to the particles pre loading.

Nanoparticles encompassed in the present invention may be provided in different forms, e.g., as solid nanoparticles (e.g., metal such as silver, gold, iron, titanium), non-metal, lipid-based solids, polymers), suspensions of nanoparticles, or combinations thereof. Metal, dielectric, and semiconductor nanoparticles may be prepared, as well as hybrid structures (e.g., core-shell nanoparticles). Nanoparticles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft nanoparticles have been manufactured, and are within the scope of the present invention. A prototype nanoparticle of semi-solid nature is the liposome. Various types of liposome nanoparticles are currently used clinically as delivery systems for anticancer drugs and vaccines. Nanoparticles with one half hydrophilic and the other half hydrophobic are termed Janus particles and are particularly effective for stabilizing emulsions. They can self-assemble at water/oil interfaces and act as solid surfactants.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarization interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

CRISPR enzyme mRNA and guide RNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), whereinb1168particles are formed using an efficient, multistep process wherein first, effector protein and RNA are mixed together, e.g., at a 1:1 molar ratio, e.g., at room temperature, e.g., for 30 minutes, e.g., in sterile, nuclease free 1× PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (such as a Type V protein such as Cpf1) mRNA and guide RNA may be delivered simultaneously using particles or lipid envelopes. Examples of suitable particles include but are not limited to those described in U.S. Pat. No. 9,301,923.

For example, Su X, Fricke J, Kavanagh DG, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured nanoparticles with a poly(O-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

Liu et al. (US 20110212179) provides bimodal porous polymer microspheres comprising a base polymer, wherein the particle comprises macropores having a diameter ranging from about 20 to about 500 microns and micropores having a diameter ranging from about 1 to about 70 microns, and wherein the microspheres have a diameter ranging from about 50 to about 1100 microns.

Berg et al. (US20160174546) a nanolipid delivery system, in particular a nano-particle concentrate, comprising: a composition comprising a lipid, oil or solvent, the composition having a viscosity of less than 100 cP at 25.degree. C. and a Kauri Butanol solvency of greater than 25 Kb; and at least one amphipathic compound selected from the group consisting of an alkoxylated lipid, an alkoxylated fatty acid, an alkoxylated alcohol, a heteroatomic hydrophilic lipid, a heteroatomic hydrophilic fatty acid, a heteroatomic hydrophilic alcohol, a diluent, and combinations thereof, wherein the compound is derived from a starting compound having a viscosity of less than 1000 cP at 50.degree. C., wherein the concentrate is configured to provide a stable nano emulsion having a D50 and a mean average particle size distribution of less than 100 nm when diluted.

Liu et al. (US 20140301951) provides a protocell nanostructure comprising: a porous particle core comprising a plurality of pores; and at least one lipid bilayer surrounding the porous particle core to form a protocell, wherein the protocell is capable of loading one or more cargo components to the plurality of pores of the porous particle core and releasing the one or more cargo components from the porous particle core across the surrounding lipid bilayer.

Chromy et al. (US 20150105538) provides methods and systems for assembling, solubilizing and/or purifying a membrane associated protein in a nanolipoprotein particle, which comprise a temperature transition cycle performed in presence of a detergent, wherein during the temperature transition cycle the nanolipoprotein components are brought to a temperature above and below the gel to liquid crystallin transition temperature of the membrane forming lipid of the nanolipoprotein particle.

Bader et al. (US 20150250725), provides a method for producing a lipid particle comprising the following: i) providing a first solution comprising denatured apolipoprotein, ii) adding the first solution to a second solution comprising at least two lipids and a detergent but no apolipoprotein, and iii) removing the detergent from the solution obtained in ii) and thereby producing a lipid particle.

Mirkin et al., (US20100129793) provides a method of preparing a composite particle comprising the steps of (a) admixing a dielectric component and a magnetic component to form a first intermediate, (b) admixing the first intermediate and gold seeds to form a second intermediate, and (c) forming a gold shell on the second intermediate by admixing the second intermediate with a gold source and a reducing agent to form said composite particle.

Other gold nanoparticle-based systems are also contemplated. In one embodiment, Cas9 RNP can be delivered in a vehicle composed of gold nanoparticles conjugated with DNA, which are complexed with donor DNA, Cas9 RNP, and the endosomal disruptive polymer PAsp(DET). See, e.g. Lee et al., "Nanoparticle delivery of Cas9 ribonucleoprotein and donor DNA in vivo induces homology-directed DNA repair" Nat Biomed Eng. 2017; 1: 889-901. In another embodiment, Cas9 RNP can be delivered into the cell cytoplasm and nucleus using arginine-functionalized gold nanoparticles. See, e.g. Mout et al., "Cytosolic and Nuclear Delivery of CRISPR/Cas9-ribonucleoprotein for Gene Editing Using Arginine Functionalized Gold Nanoparticles" Bio Protoc. 2017 Oct. 20; 7(20).

In one embodiment, particles/nanoparticles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated.

The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X.,et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, particles/nanoparticles that can deliver RNA to a cancer cell to stop tumor growth developed by Dan Anderson's lab at MIT may be used/and or adapted to the CRISPR Cas system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

The lipid particles developed by the Qiaobing Xu's lab at Tufts University may be used/adapted to the present delivery system for cancer therapy. See Wang et al., J. Control Release, 2017 Jan. 31. pii: 50168-3659(17)30038-X. doi: 10.1016/j.jconrel.2017.01.037. [Epub ahead of print]; Altmoglu et al., Biomater Sci., 4(12):1773-80, Nov. 15, 2016; Wang et al., PNAS, 113(11):2868-73 Mar. 15, 2016; Wang et al., PloS One, 10(11): e0141860. doi: 10.1371/journal-.pone.0141860. eCollection 2015, Nov. 3, 2015; Takeda et al., Neural Regen Res. 10(5):689-90, May 2015; Wang et al., Adv. Healthc Mater., 3(9):1398-403, September 2014; and Wang et al., Agnew Chem Int Ed Engl., 53(11):2893-8, Mar. 10, 2014.

US patent application 20110293703 relates to lipidoid compounds are also particularly useful in the administration of polynucleotides, which may be applied to deliver the CRISPR Cas system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the CRISPR Cas system of the present invention.

In another embodiment, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated.

Zhu et al. (US20140348900) provides for a process for preparing liposomes, lipid discs, and other lipid nanoparticles using a multi-port manifold, wherein the lipid solution stream, containing an organic solvent, is mixed with two or more streams of aqueous solution (e.g., buffer). In some aspects, at least some of the streams of the lipid and aqueous solutions are not directly opposite of each other. Thus, the process does not require dilution of the organic solvent as an additional step. In some embodiments, one of the solutions may also contain an active pharmaceutical ingredient (API). This invention provides a robust process of liposome manufacturing with different lipid formulations and different payloads. Particle size, morphology, and the manufacturing scale can be controlled by altering the port size and number of the manifold ports, and by selecting the flow rate or flow velocity of the lipid and aqueous solutions.

Cullis et al. (US 20140328759) provides limit size lipid nanoparticles with a diameter from 10-100 nm, in particular comprising a lipid bilayer surrounding an aqueous core. Methods and apparatus for preparing such limit size lipid nanoparticles are also disclosed.

Manoharan et al. (US 20140308304) provides cationic lipids of formula (I)

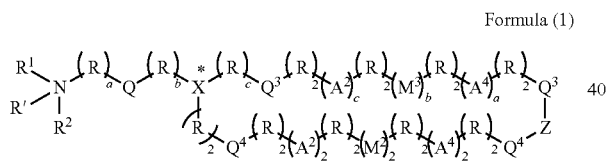

Formula (1)

or a salt thereof, wherein X is N or P; R' is absent, hydrogen, or alkyl; with respect to $R^1$ and $R^2$, (i) $R^1$ and $R^2$ are each, independently, optionally substituted alkyl, alkenyl, alkynyl, cycloalkyl, cycloalkylalkyl, heterocycle or $R^{10}$; (ii) $R^1$ and $R^2$, together with the nitrogen atom to which they are attached, form an optionally substituted heterocylic ring; or (iii) one of $R^1$ and $R^2$ is optionally substituted alkyl, alkenyl, alkynyl, cycloalkyl, cycloalkylalkyl, or heterocycle, and the other forms a 4-10 member heterocyclic ring or heteroaryl with (a) the adjacent nitrogen atom and (b) the $(R)_a$ group adjacent to the nitrogen atom; each occurrence of R is, independently, —$(CR^3R^4)$—; each occurrence of $R^3$ and $R^4$ are, independently H, halogen, OH, alkyl, alkoxy, —NH.sub.2, alkylamino, or dialkylamino; or $R^3$ and $R^4$, together with the carbon atom to which they are directly attached, form a cycloalkyl group, wherein no more than three R groups in each chain attached to the atom X* are cycloalkyl; each occurrence of R.sup.10 is independently selected from PEG and polymers based on poly(oxazoline), poly(ethylene oxide), poly(vinyl alcohol), poly(glycerol), poly(N-vinylpyrrolidone), poly[N-(2-hydroxypropyl)methacrylamide] and poly(amino acid)s, wherein (i) the PEG or polymer is linear or branched, (ii) the PEG or polymer is polymerized by n subunits, (iii) n is a number-averaged degree of polymerization between 10 and 200 units, and (iv) wherein the compound of formula has at most two $R^{10}$ groups; Q is absent or is —O—, —NH—, —S—, —C(O)O—, —OC(O)—, —C(O)N($R^4$)—, —N($R^5$)C(O)—, —S—S—, —OC(O)O—, —O—N.dbd.C($R^5$)—, —C($R^5$).dbd.N—O—, —OC(O)N($R^5$)—, —N($R^5$)C(O)N($R^5$)—, —N($R^5$)C(O)O—, —C(O)S—, —C(S)O— or —C($R^5$).dbd.N—O—C(O)—; $Q^1$ and $Q^2$ are each, independently, absent, —O—, —S—, —OC(O)—, —C(O)O—, —SC(O)—, —C(O)S—, —OC(S)—, —C(S)O—, —S—S—, —C(O)(N$R^5$)—, —N($R^5$)C(O)—, —C(S)(N$R^5$)—, —N($R^5$)C(O)—, —N($R^5$)C(O)N($R^5$)—, or —OC(O)O—; $Q^3$ and $Q^4$ are each, independently, H, —$(CR^3R^4)$—, aryl, or a cholesterol moiety; each occurrence of $A^1$, $A^2$, $A^3$ and $A^4$ is, independently, —$(CR^5R^5$—$CR^5$.dbd.$CR^5)$—; each occurrence of $R^5$ is, independently, H or alkyl; $M^1$ and $M^2$ are each, independently, a biodegradable group (e.g., —OC(O)—, —C(O)O—, —SC(O)—, —C(O)S—, —OC(S)—, —C(S)O—, —S—S—, —C($R^5$).dbd.N—, —N.dbd.C($R^5$)—, —C($R^5$).dbd.N—O—, —O—N.dbd.C($R^5$)—, —C(O)(NR5)—, —N(R5)C(O)—, —C(S)(N$R^5$)—, —N($R^5$)C(O)—, —N($R^5$)C(O)N($R^5$)—, —OC(O)O—, —OSi($R^5$).sub.2O—, —C(O)($CR^3R^4$)C(O)O—, or —OC(O)($CR^3R^4$)C(O)—); Z is absent, alkylene or —O—P(O)(OH)—O—; each— attached to Z is an optional bond, such that when Z is absent, $Q^3$ and $Q^4$ are not directly covalently bound together; a is 1, 2, 3, 4, 5 or 6; b is 0, 1, 2, or 3; c, d, e, f, i, j, m, n, q and r are each, independently, 0, 1, 2, 3, 4, 5, 6, 7, 8, 9, or 10; g and h are each, independently, 0, 1 or 2; k and 1 are each, independently, 0 or 1, where at least one of k and 1 is 1; and o and p are each, independently, 0, 1 or 2, wherein $Q^3$ and $Q^4$ are each, independently, separated from the tertiary atom marked with an asterisk (X*) by a chain of 8 or more atoms. The cationic lipid can be used with other lipid components such as cholesterol and PEG-lipids to form lipid nanoparticles with oligonucleotides, to facilitate the cellular uptake and endosomal escape, and to knockdown target mRNA both in vitro and in vivo.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 g/ml of LNP or CRISPR-Cas RNA in or associated with the LNP may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-2200, December 2011. The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-O-[2"-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific CRISPR Cas RNA may be encapsulated in LNPs containing DLinDAP, DLinDMA, DLinK-DMA, and DLinKC2-DMA (cationic lipid:DSPC: CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted nanoparticles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a CRISPR-Cas system or components thereof.

Preparation of large LNPs may be used/and or adapted from Rosin et al, Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate: DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an RNA to total lipid ratio of approximately 1:10 (wt:wt), followed by incubation for 30 minutes at 37° C. to form loaded LNPs. The mixture may be subsequently dialyzed overnight in PBS and filtered with a 0.45-am syringe filter.

Preassembled recombinant CRISPR-Cas complexes comprising Cas and crRNA may be transfected, for example by electroporation, resulting in high mutation rates and absence of detectable off-target mutations. Hur, J. K. et al, Targeted mutagenesis in mice by electroporation of Cas ribonucleoproteins, Nat Biotechnol. 2016 Jun. 6. doi: 10.1038/nbt.3596. [Epub ahead of print]

In terms of local delivery to the brain, this can be achieved in various ways. For instance, material can be delivered intrastriatally e.g. by injection. Injection can be performed stereotactically via a craniotomy.

Enhancing NHEJ or HR efficiency is also helpful for delivery. It is preferred that NHEJ efficiency is enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

In some embodiments, sugar-based particles may be used, for example GalNAc, as described herein and with reference to WO2014118272 (incorporated herein by reference) and Nair, J K et al., 2014, Journal of the American Chemical Society 136 (49), 16958-16961) and the teaching herein, especially in respect of delivery applies to all particles unless otherwise apparent. This may be considered to be a sugar-based particle and further details on other particle delivery systems and/or formulations are provided herein. GalNAc can therefore be considered to be a particle in the sense of the other particles described herein, such that general uses and other considerations, for instance delivery of said particles, apply to GalNAc particles as well. A solution-phase conjugation strategy may for example be used to attach triantennary GalNAc clusters (mol. wt. -2000) activated as PFP (pentafluorophenyl) esters onto 5'-hexy-lamino modified oligonucleotides (5'-HA ASOs, mol. wt. -8000 Da; Ostergaard et al., Bioconjugate Chem., 2015, 26 (8), pp 1451-1455). Similarly, poly(acrylate) polymers have been described for in vivo nucleic acid delivery (see WO2013158141 incorporated herein by reference). In further alternative embodiments, pre-mixing CRISPR nanoparticles (or protein complexes) with naturally occurring serum proteins may be used in order to improve delivery (Akinc A et al, 2010, Molecular Therapy vol. 18 no. 7, 1357-1364).

Additional nanoparticle configurations are also contemplated In another embodiment, Cas9 protein and sgRNA can be delivered into cells using "CRISPR-delivery particles," (CriPs), composed of nano-size complexes of Cas9 protein and sgRNA that are coated with an amphipathic peptide called Endo-Porter (EP) an amphipathic α-helical peptide composed of leucine and histidine residues that mediates entry into cells. See, e.g. Shen et al., "CRISPR-delivery particles targeting nuclear receptor-interacting protein 1 (Nrip1) in adipose cells to enhance energy expenditure" J Biol Chem. 2018 Nov. 2; 293(44):17291-17305. In another embodiment, Cas9 plasmids and synthesized sgRNAs can be delivered into cells encapsulated in PEGylated nanoparticles (named P-HNPs) based on the cationic α-helical polypeptide poly(γ-4-((2-(piperidin-1-yl)ethyl)aminomethyl)benzyl-1-glutamate). See, e.g. Wang et al., "Nonviral gene editing via CRISPR/Cas9 delivery by membrane-disruptive and endosomolytic helical polypeptide" Proc Natl Acad Sci USA. 2018 May 8; 115(19): 4903-4908. In another embodiment, a CRISPR-Cas9 plasmid can be incorporated into a self assembled nanoparticle. The plasmid can be complexed with protamine sulfate and the resulting complex decorated by a multi-functional outer layer composed of an endosomolytic peptide (KALA) and aptamer AS1411 incorporated carboxymethyl chitosan. See, e.g. Liu et al., "Tumor targeted genome editing mediated by a multi-functional gene vector for regulating cell behaviors." J Control Release. 2018 Dec. 10; 291:90-98.In another embodiment, spCas9 and sgRNA RNP complexes can be delivered via a vesicle decorated with the fusogenic glycoprotein of the vesicular stomatitis virus (VSV-G). See, e.g. "VSV-G-Enveloped Vesicles for Traceless Delivery of CRISPR-Cas9" Montagna et al., Sci Rep. 2018 Nov. 2; 8(1):16304. In another embodiment, Cas9 RNP can be delivered by encapsulation in a nanoscale zeolitic imidazole framework (ZIF), in which enhanced endosomal escape is promoted by the protonated imidazole moieties. See, e.g. Alsaiari et al., "Endosomal Escape and Delivery of CRISPR/Cas9 Genome Editing Machinery Enabled by Nanoscale Zeolitic Imidazolate Framework" J Am Chem Soc. 2018 Jan. 10; 140(1): 143-146.

Also contemplated are filtration-based systems. In one embodiment, Cas9 and sgRNA RNP complexes can be delivered into patient-derived hematopoietic stem and progenitor cells (HSPCs) ex vivo using TRansmembrane Internalization Assisted by Membrane Filtration (TRIAMF), a method to deliver RNPs into HSPCs by passing a RNP and cell mixture through a filter membrane. See, e.g. Yen et al., "TRIAMF: A New Method for Delivery of Cas9 Ribonucleoprotein Complex to Human Hematopoietic Stem Cells" Sci Rep. 2018 Nov. 2; 8(1):16304.

Nanoclews

Further, the CRISPR system may be delivered using nanoclews, for example as described in Sun W et al, Cocoon-like self-degradable DNA nanoclew for anticancer drug delivery., J Am Chem Soc. 2014 Oct. 22; 136(42): 14722-5. doi: 10.1021/ja5088024. Epub 2014 Oct. 13. ; or in Sun W et al, *Self-Assembled DNA Nanoclews for the Efficient Delivery of CRISPR-Cas9 for Genome Editing.*, Angew Chem Int Ed Engl. 2015 Oct. 5; 54(41):12029-33. doi: 10.1002/anie.201506030. Epub 2015 Aug. 27.

LNP

In some embodiments, delivery is by encapsulation of the Cas protein or mRNA form in a lipid particle such as an LNP. In some embodiments, therefore, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 g/ml of LNP or CRISPR-Cas RNA in or associated with the LNP may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific CRISPR Cas RNA may be encapsulated in LNPs containing DLinDAP, DLinDMA, DLinK-DMA, and DLinKC2-DMA (cationic lipid:DSPC: CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted nanoparticles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a CRISPR-Cas system or components thereof.

A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an RNA to total lipid ratio of approximately 1:10 (wt:wt), followed by incubation for 30 minutes at 37° C. to form loaded LNPs. The mixture may be subsequently dialyzed overnight in PBS and filtered with a 0.45-am syringe filter.

Spherical Nucleic Acid (SNA™) constructs and other nanoparticles (particularly gold nanoparticles) are also contemplated as a means to delivery CRISPR-Cas system to intended targets. Significant data show that AuraSense Therapeutics' Spherical Nucleic Acid (SNA™) constructs, based upon nucleic acid-functionalized gold nanoparticles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 $10^9$:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling nanoparticles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of CRISPR Cas is envisioned for delivery in the self-assembling nanoparticles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclodo-decane-1,4,7,10-tetraacetic acid mono(N-hydroxysuccinimide ester) (DOTA-NHSester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA nanoparticles may be formed by using cyclodextrin-containing polycations. Typically, nanoparticles were formed in water at a charge ratio of 3 (+/−) and an siRNA concentration of 0.5 g/liter. One percent of the adamantane-PEG molecules on the surface of the targeted nanoparticles were modified with Tf (adamantane-PEG-Tf). The nanoparticles were suspended in a 5% (wt/vol) glucose carrier solution for injection.

Davis et al. (Nature, Vol 464, 15 Apr. 2010) conducts a RNA clinical trial that uses a targeted nanoparticle-delivery system (clinical trial registration number NCT00689065). Patients with solid cancers refractory to standard-of-care therapies are administered doses of targeted nanoparticles on days 1, 3, 8 and 10 of a 21-day cycle by a 30-min intravenous infusion. The nanoparticles consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These nanoparticles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumors, Davis et al. investigated biopsies from three patients from three different dosing cohorts; patients A, B and C, all of whom had metastatic melanoma and received CALAA-01 doses of 18, 24 and 30 mg m-2 siRNA, respectively. Similar doses may also be contemplated for the CRISPR Cas system of the present invention. The delivery of the invention may be achieved with nanoparticles containing a linear, cyclodextrin-based polymer (CDP), a human transferrin protein (TF) targeting ligand displayed on the exterior of the nanoparticle to engage TF receptors (TFR) on the surface of the cancer cells and/or a hydrophilic polymer (for example, polyethylene glycol (PEG) used to promote nanoparticle stability in biological fluids).

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid.

U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material.

U.S. Pat. No. 5,855,913, incorporated herein by reference, provides a particulate composition having aerodynamically light particles having a tap density of less than 0.4 g/cm3 with a mean diameter of between 5 μm and 30 μm, incorporating a surfactant on the surface thereof for drug delivery to the pulmonary system.

U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system.

U.S. Pat. No. 5,543,158, incorporated herein by reference, provides biodegradable injectable particles having a biodegradable solid core containing a biologically active material and poly(alkylene glycol) moieties on the surface.

WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such conjugated lipomers can be used in the context of the CRISPR-Cas system to achieve in vitro, ex vivo and in vivo genomic perturbations to modify gene expression, including modulation of protein expression.

In one embodiment, the nanoparticle may be epoxide-modified lipid-polymer, advantageously 7C1 (see, e.g., James E. Dahlman and Carmen Barnes et al. Nature Nanotechnology (2014) published online 11 May 2014, doi: 10.1038/nnano.2014.84). C71 was synthesized by reacting C15 epoxide-terminated lipids with PEI600 at a 14:1 molar ratio, and was formulated with C14PEG2000 to produce nanoparticles (diameter between 35 and 60 nm) that were stable in PBS solution for at least 40 days.

An epoxide-modified lipid-polymer may be utilized to deliver the CRISPR-Cas system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

In some embodiments, the LNP for delivering the RNA molecules is prepared by methods known in the art, such as those described in, for example, WO 2005/105152 (PCT/EP2005/004920), WO 2006/069782 (PCT/EP2005/014074), WO 2007/121947 (PCT/EP2007/003496), and WO 2015/082080 (PCT/EP2014/003274), which are herein incorporated by reference. LNPs aimed specifically at the enhanced and improved delivery of siRNA into mammalian cells are described in, for example, Aleku et al., Cancer Res., 68(23): 9788-98 (Dec. 1, 2008), Strumberg et al., Int. J. Clin. Pharmacol. Ther., 50(1): 76-8 (January 2012), Schultheis et al., J. Clin. Oncol., 32(36): 4141-48 (Dec. 20, 2014), and Fehring et al., Mol. Ther., 22(4): 811-20 (Apr. 22, 2014), which are herein incorporated by reference and may be applied to the present technology.

In some embodiments, the LNP includes any LNP disclosed in WO 2005/105152 (PCT/EP2005/004920), WO 2006/069782 (PCT/EP2005/014074), WO 2007/121947 (PCT/EP2007/003496), and WO 2015/082080 (PCT/EP2014/003274).

In some embodiments, the LNP includes at least one lipid having Formula I:

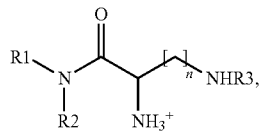

(Formula I)

wherein R1 and R2 are each and independently selected from the group comprising alkyl, n is any integer between 1 and 4, and R3 is an acyl selected from the group comprising lysyl, ornithyl, 2,4-diaminobutyryl, histidyl and an acyl moiety according to Formula II:

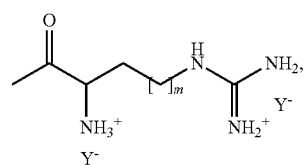

(Formula II)

wherein m is any integer from 1 to 3 and Y— is a pharmaceutically acceptable anion. In some embodiments, a lipid according to Formula I includes at least two asymmetric C atoms. In some embodiments, enantiomers of Formula I include, but are not limited to, R-R; S-S; R—S and S-R enantiomer.

In some embodiments, R1 is lauryl and R2 is myristyl. In another embodiment, R1 is palmityl and R2 is oleyl. In some embodiments, m is 1 or 2. In some embodiments, Y— is selected from halogenids, acetate or trifluoroacetate.

In some embodiments, the LNP comprises one or more lipids select from:

β-arginyl-2,3-diamino propionic acid-N-palmityl-N-oleyl-amide trihydrochloride (Formula III):

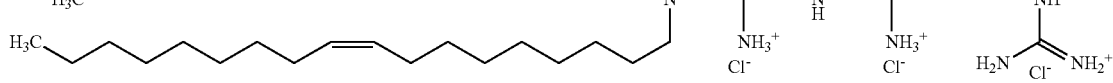

(Formula III)

β-arginyl-2,3-diamino propionic acid-N-lauryl-N-myristyl-amide trihydrochloride (Formula IV):

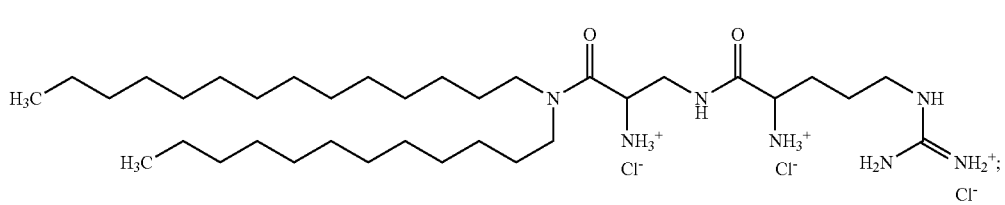

(Formula IV)

and

ε-arginyl-lysine-N-lauryl-N-myristyl-amide trihydrochloride (Formula V):

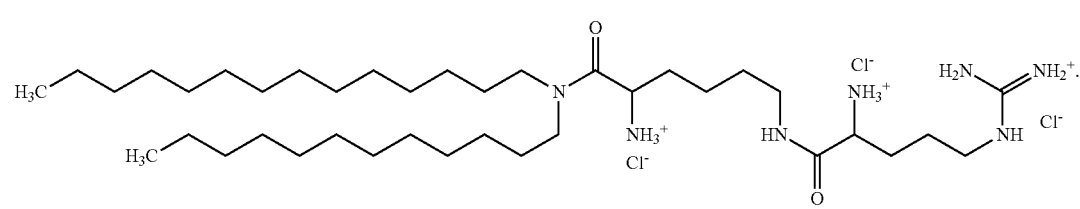

(Formula V)

In some embodiments, the LNP also includes a constituent. By way of example, but not by way of limitation, in some embodiments, the constituent is selected from peptides, proteins, oligonucleotides, polynucleotides, nucleic acids, or a combination thereof. In some embodiments, the constituent is an antibody, e.g., a monoclonal antibody. In some embodiments, the constituent is a nucleic acid selected from, e.g., ribozymes, aptamers, spiegelmers, DNA, RNA, PNA, LNA, or a combination thereof. In some embodiments, the nucleic acid is gRNA and/or mRNA.

In some embodiments, the constituent of the LNP comprises an mRNA encoding a CRIPSR effector protein. In some embodiments, the constituent of the LNP comprises an mRNA encoding a Type-II, Type-V, or Type-VI CRIPSR effector protein. In some embodiments, the constituent of the LNP comprises an mRNA encoding an RNA-guided DNA binding protein. In some embodiments, the constituent of the LNP comprises an mRNA encoding an RNA-guided RNA binding protein.

In some embodiments, the constituent of the LNP further comprises one or more guide RNA. In some embodiments, the LNP is configured to deliver the aforementioned mRNA and guide RNA to vascular endothelium. In some embodiments, the LNP is configured to deliver the aforementioned mRNA and guide RNA to pulmonary endothelium. In some embodiments, the LNP is configured to deliver the aforementioned mRNA and guide RNA to liver. In some embodiments, the LNP is configured to deliver the aforementioned mRNA and guide RNA to lung. In some embodiments, the LNP is configured to deliver the aforementioned mRNA and guide RNA to hearts. In some embodiments, the LNP is configured to deliver the aforementioned mRNA and guide RNA to spleen. In some embodiments, the LNP is configured to deliver the aforementioned mRNA and guide RNA to kidney. In some embodiments, the LNP is configured to deliver the aforementioned mRNA and guide RNA to pancrea. In some embodiments, the LNP is configured to deliver the aforementioned mRNA and guide RNA to brain. In some embodiments, the LNP is configured to deliver the aforementioned mRNA and guide RNA to macrophages.

In some embodiments, the LNP also includes at least one helper lipid. In some embodiments, the helper lipid is selected from phospholipids and steroids. In some embodiments, the phospholipids are di- and/or monoester of the phosphoric acid. In some embodiments, the phospholipids are phosphoglycerides and/or sphingolipids. In some embodiments, the steroids are naturally occurring and/or synthetic compounds based on the partially hydrogenated cyclopenta[a]phenanthrene. In some embodiments, the steroids contain 21 to 30 C atoms. In some embodiments, the steroid is cholesterol. In some embodiments, the helper lipid is selected from 1,2-diphytanoyl-sn-glycero-3-phosphoethanolamine (DPhyPE), ceramide, and 1,2-dioleylsn-glycero-3-phosphoethanolamine (DOPE).

In some embodiments, the at least one helper lipid comprises a moiety selected from the group comprising a PEG moiety, a HEG moiety, a polyhydroxyethyl starch (polyHES) moiety and a polypropylene moiety. In some embodiments, the moiety has a molecule weight between about 500 to 10,000 Da or between about 2,000 to 5,000 Da. In some embodiments, the PEG moiety is selected from 1,2-distearoyl-sn-glycero-3 phosphoethanolamine, 1,2-dialkyl-sn-glycero-3-phosphoethanolamine, and Ceramide-PEG. In some embodiments, the PEG moiety has a molecular weight between about 500 to 10,000 Da or between about 2,000 to 5,000 Da. In some embodiments, the PEG moiety has a molecular weight of 2,000 Da.

In some embodiments, the helper lipid is between about 20 mol % to 80 mol % of the total lipid content of the composition. In some embodiments, the helper lipid component is between about 35 mol % to 65 mol % of the total lipid content of the LNP. In some embodiments, the LNP includes lipids at 50 mol % and the helper lipid at 50 mol % of the total lipid content of the LNP.

In some embodiments, the LNP includes any of -3-arginyl-2,3-diaminopropionic acid-N-palmityl-N-oleyl-amide trihydrochloride, -arginyl-2,3-diaminopropionic acid-N-lauryl-N-myristyl-amide trihydrochloride or arginyl-lysine-N-lauryl-N-myristyl-amide trihydrochloride in combination with DPhyPE, wherein the content of DPhyPE is about 80 mol %, 65 mol %, 50 mol % and 35 mol % of the overall lipid content of the LNP. In some embodiments, the LNP includes -arginyl-2,3-diamino propionic acid-N-pahnityl-N-oleyl-amide trihydrochloride (lipid) and 1,2-diphytanoyl-sn-glycero-3-phosphoethanolamine (helper lipid). In some embodiments, the LNP includes -arginyl-2,3-diamino propionic acid-N-palmityl-N-oleyl-amide trihydrochloride (lipid), 1,2-diphytanoyl-sn-glycero-3-phosphoethanolamine (first helper lipid), and 1,2-disteroyl-sn-glycero-3-phosphoethanolamine-PEG2000 (second helper lipid).

In some embodiments, the second helper lipid is between about 0.05 mol % to 4.9 mol % or between about 1 mol % to 3 mol % of the total lipid content. In some embodiments, the LNP includes lipids at between about 45 mol % to 50 mol % of the total lipid content, a first helper lipid between about 45 mol % to 50 mol % of the total lipid content, under the proviso that there is a PEGylated second helper lipid between about 0.1 mol % to 5 mol %, between about 1 mol % to 4 mol %, or at about 2 mol % of the total lipid content, wherein the sum of the content of the lipids, the first helper lipid, and of the second helper lipid is 100 mol % of the total lipid content and wherein the sum of the first helper lipid and the second helper lipid is 50 mol % of the total lipid content. In some embodiments, the LNP comprises: (a) 50 mol % of arginyl-2,3-diamino propionic acid-N-palmityl-N-oleyl-amide trihydrochloride, 48 mol % of 1,2-diphytanoyl-sn-glycero-3-phosphoethanolamine; and 2 mol % 1,2-distearoyl-sn-glycero-3-phosphoethanolamine-PEG2000; or (b) 50 mol % of -arginyl-2,3-diamino propionic acid-N-palmityl-N-oleyl-amide trihydrocloride, 49 mol % 1,2-diphytanoyl-sn-glycero-3-phosphoethanolamine; and 1 mol % N(Carbonyl-methoxypolyethylenglycol-2000)-1,2-distearoyl-sn-glycero3-phosphoethanolamine, or a sodium salt thereof.

In some embodiments, the LNP contains a nucleic acid, wherein the charge ratio of nucleic acid backbone phosphates to cationic lipid nitrogen atoms is about 1: 1.5-7 or about 1:4.

In some embodiments, the LNP also includes a shielding compound, which is removable from the lipid composition under in vivo conditions. In some embodiments, the shielding compound is a biologically inert compound. In some embodiments, the shielding compound does not carry any charge on its surface or on the molecule as such. In some embodiments, the shielding compounds are polyethylenglycoles (PEGs), hydroxyethylglucose (HEG) based polymers, polyhydroxyethyl starch (polyHES) and polypropylene. In some embodiments, the PEG, HEG, polyHES, and a polypropylene weight between about 500 to 10,000 Da or between about 2000 to 5000 Da. In some embodiments, the shielding compound is PEG2000 or PEG5000.

In some embodiments, the LNP includes at least one lipid, a first helper lipid, and a shielding compound that is removable from the lipid composition under in vivo conditions. In some embodiments, the LNP also includes a second helper lipid. In some embodiments, the first helper lipid is ceramide. In some embodiments, the second helper lipid is ceramide. In some embodiments, the ceramide comprises at least one short carbon chain substituent of from 6 to 10 carbon atoms. In some embodiments, the ceramide comprises 8 carbon atoms. In some embodiments, the shielding compound is attached to a ceramide. In some embodiments, the shielding compound is attached to a ceramide. In some embodiments, the shielding compound is covalently attached to the ceramide. In some embodiments, the shielding compound is attached to a nucleic acid in the LNP. In some embodiments, the shielding compound is covalently attached to the nucleic acid. In some embodiments, the shielding compound is attached to the nucleic acid by a linker. In some embodiments, the linker is cleaved under physiological conditions. In some embodiments, the linker is selected from ssRNA, ssDNA, dsRNA, dsDNA, peptide, S-S-linkers and pH sensitive linkers. In some embodiments, the linker moiety is attached to the 3' end of the sense strand of the nucleic acid. In some embodiments, the shielding compound comprises a pH-sensitive linker or a pH-sensitive moiety. In some embodiments, the pH-sensitive linker or pH-sensitive moiety is an anionic linker or an anionic moiety. In some embodiments, the anionic linker or anionic moiety is less anionic or neutral in an acidic environment. In some embodiments, the pH-sensitive linker or the pH-sensitive moiety is selected from the oligo (glutamic acid), oligophenolate(s) and diethylene triamine penta acetic acid.

In any of the LNP embodiments in the previous paragraph, the LNP can have an osmolality between about 50 to 600 mosmole/kg, between about 250 to 350 mosmole/kg, or between about 280 to 320 mosmole/kg, and/or wherein the LNP formed by the lipid and/or one or two helper lipids and the shielding compound have a particle size between about 20 to 200 nm, between about 30 to 100 nm, or between about 40 to 80 nm.

In some embodiments, the shielding compound provides for a longer circulation time in vivo and allows for a better biodistribution of the nucleic acid containing LNP. In some embodiments, the shielding compound prevents immediate interaction of the LNP with serum compounds or compounds of other bodily fluids or cytoplasma membranes, e.g., cytoplasma membranes of the endothelial lining of the vasculature, into which the LNP is administered. Additionally or alternatively, in some embodiments, the shielding compounds also prevent elements of the immune system from immediately interacting with the LNP. Additionally or alternatively, in some embodiments, the shielding compound acts as an anti-opsonizing compound. Without wishing to be bound by any mechanism or theory, in some embodiments, the shielding compound forms a cover or coat that reduces the surface area of the LNP available for interaction with its environment. Additionally or alternatively, in some embodiments, the shielding compound shields the overall charge of the LNP.

In another embodiment, the LNP includes at least one cationic lipid having Formula VI:

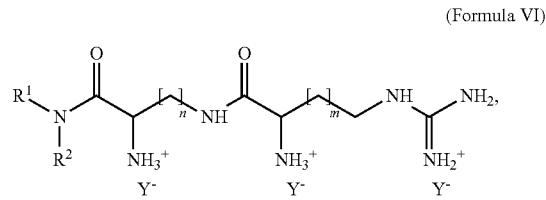

(Formula VI)

wherein n is 1, 2, 3, or 4, wherein m is 1, 2, or 3, wherein Y— is anion, wherein each of $R^1$ and $R^2$ is individually and independently selected from the group consisting of linear C12-C18 alkyl and linear C12-C18 alkenyl, a sterol compound, wherein the sterol compound is selected from the group consisting of cholesterol and stigmasterol, and a PEGylated lipid, wherein the PEGylated lipid comprises a PEG moiety, wherein the PEGylated lipid is selected from the group consisting of:

a PEGylated phosphoethanolamine of Formula VII:

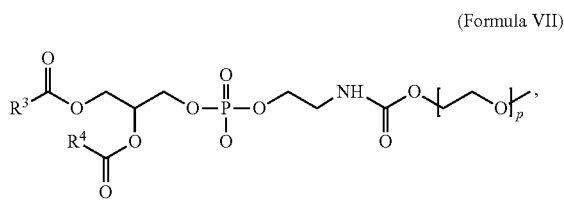

(Formula VII)

wherein $R^3$ and $R^4$ are individually and independently linear C13-C17 alkyl, and p is any integer between 15 to 130;

a PEGylated ceramide of Formula VIII:

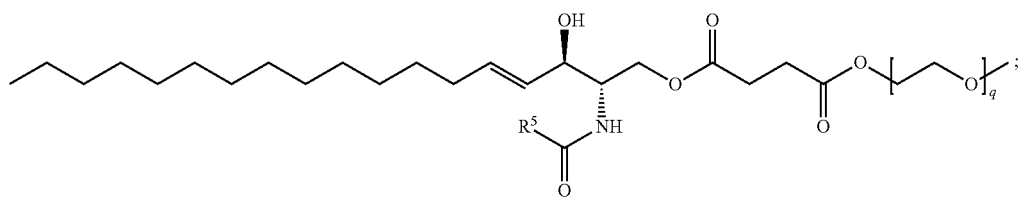

(Formula VIII)

wherein $R^5$ is linear C7-C15 alkyl, and q is any number between 15 to 130; and a PEGylated diacylglycerol of Formula IX:

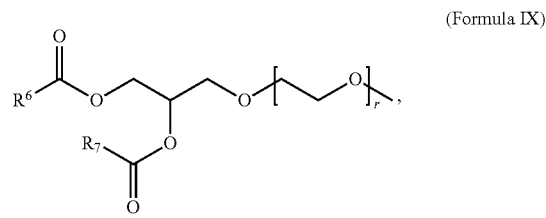

(Formula IX)

wherein each of $R^6$ and $R^7$ is individually and independently linear C11-C17 alkyl, and r is any integer from 15 to 130.

In some embodiments, $R^1$ and $R^2$ are different from each other. In some embodiments, $R^1$ is palmityl and $R^2$ is oleyl. In some embodiments, $R^1$ is lauryl and $R^2$ is myristyl. In some embodiments, $R^1$ and $R^2$ are the same. In some embodiments, each of $R^1$ and $R^2$ is individually and independently selected from the group consisting of C12 alkyl, C14 alkyl, C16 alkyl, C18 alkyl, C12 alkenyl, C14 alkenyl, C16 alkenyl and C18 alkenyl. In some embodiments, each of C12 alkenyl, C14 alkenyl, C16 alkenyl and C1 8 alkenyl comprises one or two double bonds. In some embodiments, C18 alkenyl is C18 alkenyl with one double bond between C9 and C10. In some embodiments, C18 alkenyl is cis-9-octadecyl.

In some embodiments, the cationic lipid is a compound of Formula X:

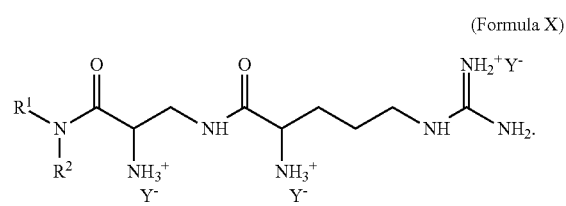

(Formula X)

In some embodiments, Y— is selected from halogenids, acetate and trifluoroacetate. In some embodiments, the cationic lipid is β-arginyl-2,3-diamino propionic acid-N-palmityl-N-oleyl-amide trihydrochloride of Formula III:

In some embodiments, the sterol compound is cholesterol.
In some embodiments, the sterol compound is stigmasterin.
In some embodiments, the PEG moiety of the PEGylated lipid has a molecular weight from about 800 to 5,000 Da. In some embodiments, the molecular weight of the PEG moiety of the PEGylated lipid is about 800 Da. In some embodiments, the molecular weight of the PEG moiety of the PEGylated lipid is about 2,000 Da. In some embodiments, the molecular weight of the PEG moiety of the PEGylated lipid is about 5,000 Da. In some embodiments, the PEGylated lipid is a PEGylated phosphoethanolamine of Formula VII, wherein each of $R^3$ and $R^4$ is individually and independently linear C13-C17 alkyl, and p is any integer from 18, 19 or 20, or from 44, 45 or 46 or from 113, 114 or 115. In some embodiments, $R^3$ and $R^4$ are the same. In some embodiments, $R^3$ and $R^4$ are different. In some embodiments, each of $R^3$ and $R^4$ is individually and independently selected from the group consisting of C13 alkyl, C15 alkyl and C17 alkyl. In some embodiments, the PEGylated phosphoethanolamine of Formula VII is 1,2-distearoyl-sn-glycero-3-phosphoethanolamine-N-[methoxy(polyethylene glycol)-2000](ammonium salt):

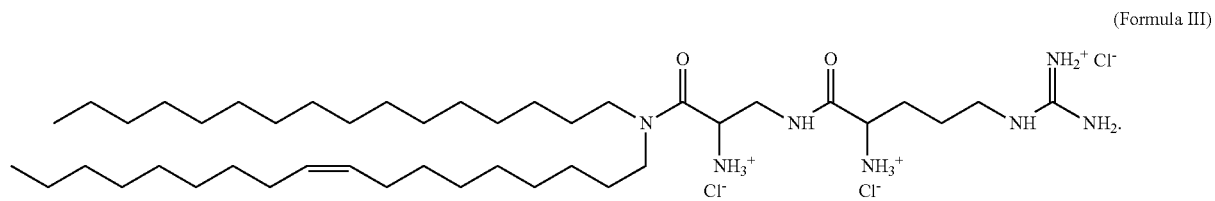 [SMILES: CCCCCCCC/C=C\CCCCCCCCN(CCCCCCCCCCCCCCCC)C(=O)C([NH3+])CNC(=O)C([NH3+])CCCNC(N)=[NH2+] ; [Cl-] ; [Cl-] ; [Cl-]]

(Formula III)

In some embodiments, the cationic lipid is β-arginyl-2,3-diamino propionic acid-N-lauryl-N-myristyl-amide trihydrochloride of Formula IV:

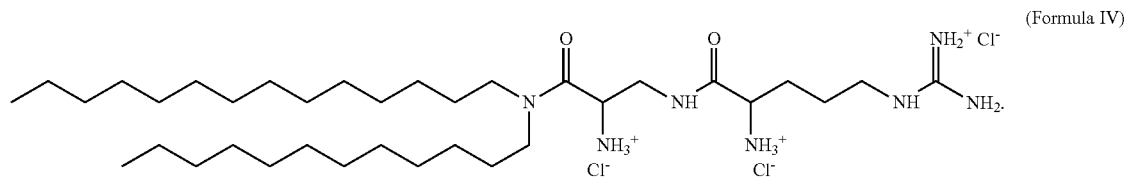 [SMILES: CCCCCCCCCCCCCCN(CCCCCCCCCCCC)C(=O)C([NH3+])CNC(=O)C([NH3+])CCCNC(N)=[NH2+] ; [Cl-] ; [Cl-] ; [Cl-]]

(Formula IV)

In some embodiments, the cationic lipid is ε-arginyl-lysine-N-lauryl-N-myristyl-amide trihydrochloride of Formula V:

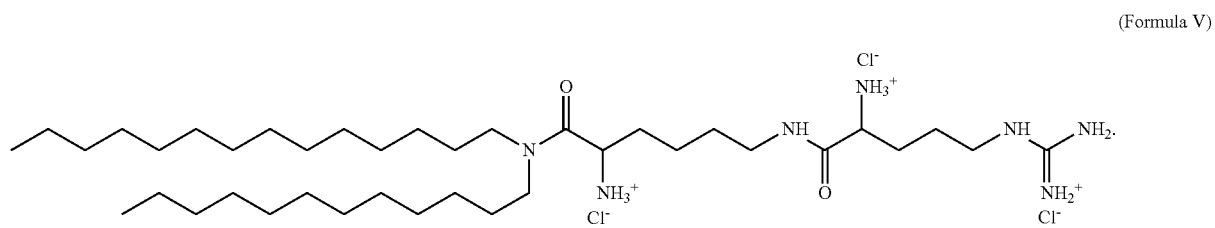 [SMILES: [Cl-] ; CCCCCCCCCCCCCCN(CCCCCCCCCCCC)C(=O)C([NH3+])CCCCNC(=O)C([NH3+])CCCNC(N)=[NH2+] ; [Cl-] ; [Cl-]]

(Formula V)

(Formula XI)

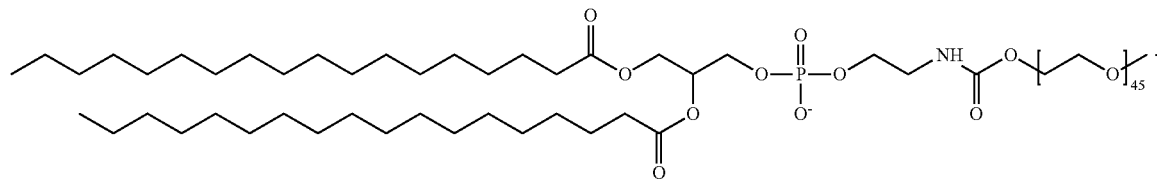

In some embodiments, the PEGylated phosphoethanolamine of Formula VII is 1,2-distearoyl-sn-glycero-3-phosphoethanolamine-N-[methoxy(polyethylene glycol)-5000](ammonium salt):

In some embodiments, the PEGylated lipid is a PEGylated diacylglycerol of Formula IX, wherein each of $R^6$ and $R^7$ is individually and independently linear C11-C17 alkyl, and r is any integer from 18, 19 or 20, or from 44, 45 or 46

(Formula XII)

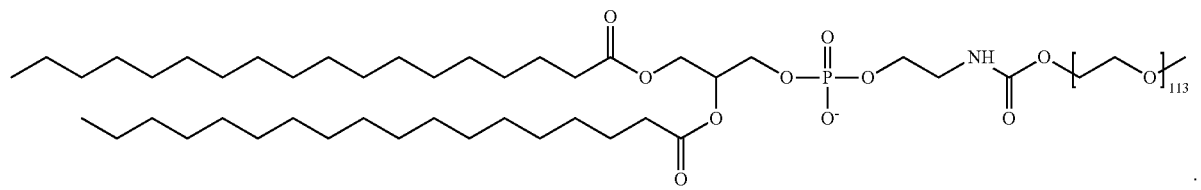

In some embodiments, the PEGylated lipid is a PEGylated ceramide of Formula VIII, wherein $R^5$ is linear C7-C15 alkyl, and q is any integer from 18, 19 or 20, or from 44, 45 or 46 or from 113, 114 or 115. In some embodiments, $R^5$ is linear C7 alkyl. In some embodiments, $R^5$ is linear C15 alkyl. In some embodiments, the PEGylated ceramide of Formula VIII is N-octanoyl-sphingosine-1-{succinyl[methoxy(polyethylene glycol)2000]}:

or from 113, 114 or 115. In some embodiments, $R^6$ and $R^7$ are the same. In some embodiments, $R^6$ and $R^7$ are different. In some embodiments, each of $R^6$ and $R^7$ is individually and independently selected from the group consisting of linear C17 alkyl, linear C15 alkyl and linear C13 alkyl. In some embodiments, the PEGylated diacylglycerol of Formula IX 1,2-Distearoyl-sn-glycerol [methoxy(polyethylene glycol) 2000]:

(Formula XIII)

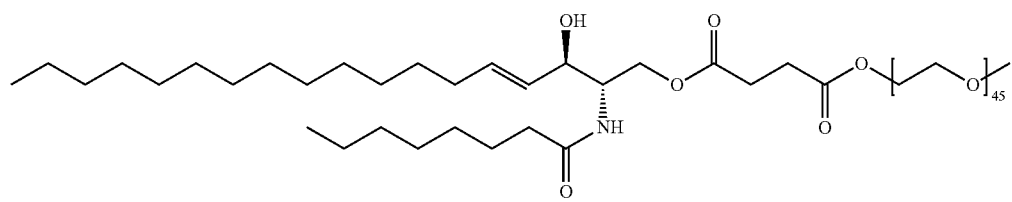

In some embodiments, the PEGylated ceramide of Formula VIII is N-palmitoyl-sphingosine-1- {succinyl[methoxy (polyethylene glycol)2000]}

(Formula XIV)

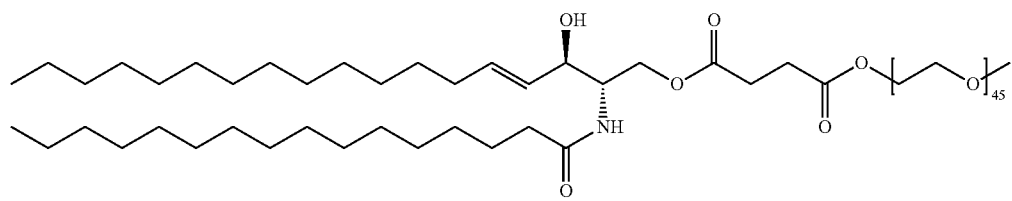

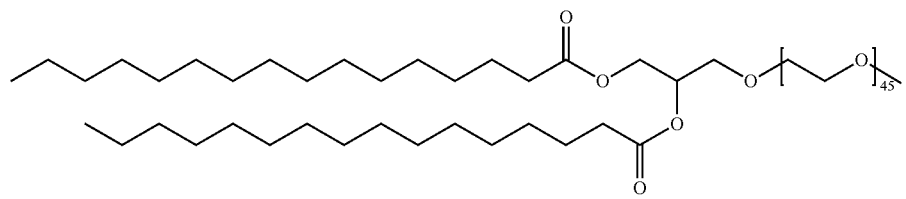

(Formula XV)

In some embodiments, the PEGylated diacylglycerol of Formula IX is 1,2-Dipalmitoyl-sn-glycerol [methoxy(polyethylene glycol)2000]:

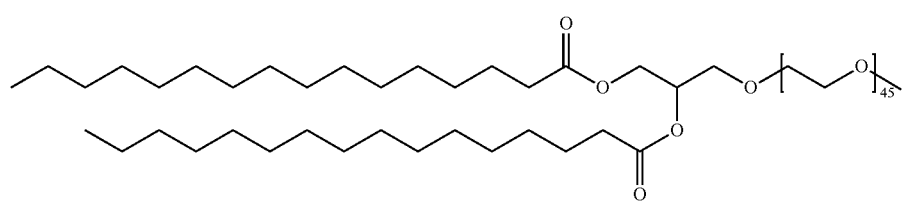

(Formula XVI)

In some embodiments, the PEGylated diacylglycerol of Formula IX is:

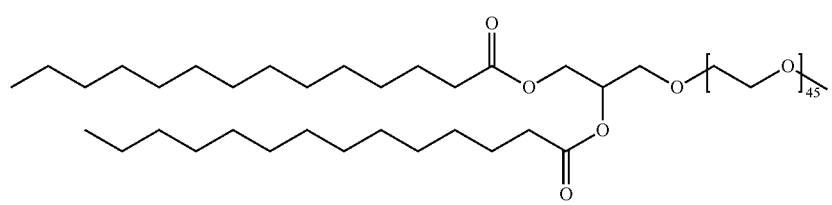

(Formula XVII)

In some embodiments, the LNP includes at least one cationic lipid selected from of Formulas III, IV, and V, at least one sterol compound selected from a cholesterol and stigmasterin, and wherein the PEGylated lipid is at least one selected from Formulas XI and XII. In some embodiments, the LNP includes at least one cationic lipid selected from Formulas III, IV, and V, at least one sterol compound selected from a cholesterol and stigmasterin, and wherein the PEGylated lipid is at least one selected from Formulas XIII and XIV. In some embodiments, the LNP includes at least one cationic lipid selected from Formulas III, IV, and V, at least one sterol compound selected from a cholesterol and stigmasterin, and wherein the PEGylated lipid is at least one selected from Formulas XV and XVI. In some embodiments, the LNP includes a cationic lipid of Formula III, a cholesterol as the sterol compound, and wherein the PEGylated lipid is Formula XI.

In any of the LNP embodiments in the previous paragraph, wherein the content of the cationic lipid composition is between about 65 mole % to 75 mole %, the content of the sterol compound is between about 24 mole % to 34 mole % and the content of the PEGylated lipid is between about 0.5 mole % to 1.5 mole %, wherein the sum of the content of the cationic lipid, of the sterol compound and of the PEGylated lipid for the lipid composition is 100 mole %. In some embodiments, the cationic lipid is about 70 mole %, the content of the sterol compound is about 29 mole % and the content of the PEGylated lipid is about 1 mole %. In some embodiments, the LNP is 70 mole % of Formula III, 29 mole % of cholesterol, and 1 mole % of Formula XI.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by nanoparticle tracking analysis (NTA) and electron microscopy. Alvarez-Erviti et al. obtained 6-12 µg of exosomes (measured based on protein concentration) per $10^6$ cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 µF resulted in the greatest retention of RNA and was used for all subsequent experiments.

Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or −]15%, P<0.001 and 61% [+ or −]13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the 0-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the CRISPR-Cas system of the present invention to therapeutic targets, especially neurodegenerative diseases. A dosage of about 100 to 1000 mg of CRISPR Cas encapsulated in about 100 to 1000 mg of RVG exosomes may be contemplated for the present invention.

El-Andaloussi et al. (Nature Protocols 7,2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ∼3 weeks. Delivery or administration according to the invention may be performed using exosomes produced from self-derived dendritic cells. From the herein teachings, this can be employed in the practice of the invention.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of CRISPR Cas into exosomes may be conducted similarly to siRNA. The exosomes may be co-cultured with monocytes and lymphocytes isolated from the peripheral blood of healthy donors. Therefore, it may be contemplated that exosomes containing CRISPR Cas may be introduced to monocytes and lymphocytes of and autologously reintroduced into a human. Accordingly, delivery or administration according to the invention may be performed using plasma exosomes.

Liposomes

The lipid, lipid particle, or lipid bylayer or lipid entity of the invention can be prepared by methods well known in the art. See Wang et al., ACS Synthetic Biology, 1, 403-07 (2012); Wang et al., PNAS, 113(11) 2868-2873 (2016); Manoharan, et al., WO 2008/042973; Zugates et al., U.S. Pat. No. 8,071,082; Xu et al., WO 2014/186366 A1 (US20160082126). Xu et provides a way to make a nanocomplex for the delivery of saporin wherein the nanocomplex comprising saporin and a lipid-like compound, and wherein the nanocomplex has a particle size of 50 nm to 1000 nm; the saporin binds to the lipid-like compound via non-covalent interaction or covalent bonding; and the lipid-like compound has a hydrophilic moiety, a hydrophobic moiety, and a linker joining the hydrophilic moiety and the hydrophobic moiety, the hydrophilic moiety being optionally charged and the hydrophobic moiety having 8 to 24 carbon atoms. Xu et al., WO 2014/186348 (US20160129120) provides examples of nanocomplexes of modified peptides or proteins comprising a cationic delivery agent and an anionic pharmaceutical agent, wherein the nanocomplex has a particle size of 50 to 1000 nm, the cationic delivery agent binds to the anionic pharmaceutical agent, and the anionic pharmaceutical agent is a modified peptide or protein formed of a peptide and a protein and an added chemical moiety that contains an anionic group. The added chemical moiety is linked to the peptide or protein via an amide group, an ester group, an ether group, a thioether group, a disulfide group, a hydrazone group, a sulfenate ester group, an amidine group, a urea group, a carbamate group, an imidoester group, or a carbonate group. More particularly these documents provide examples of lipid or lipid-like compounds that can be used to make the particle delivery system of the present invention, including compounds of the formula $B_1$—Ki-A-$K_2$-$B_2$, in which A, the hydrophilic moiety, is

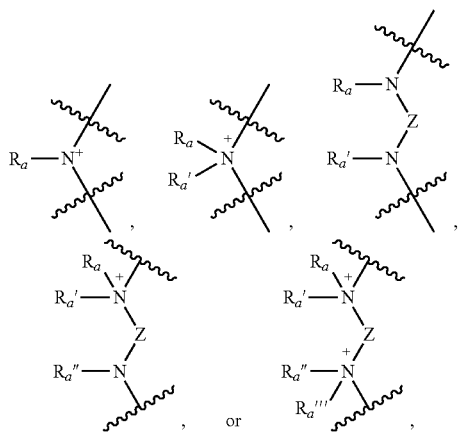

each of Ra, Ra', Ra", and Ra''', independently, being a $C_1$-$C_{20}$ monovalent aliphatic radical, a $C_1$-$C_{20\ 0}$ monovalent heteroaliphatic radical, a monovalent aryl radical, or a monovalent heteroaryl radical; and Z being a $C_1$-$C_{20}$ bivalent aliphatic radical, a $C_1$-$C_{20}$ bivalent heteroaliphatic radical, a bivalent aryl radical, or a bivalent heteroaryl radical; each of $B_1$, the hydrophobic moiety, and $B_2$, also the hydrophobic moiety, independently, is a $C_{12-20}$ aliphatic radical or a $c_{12-20}$ heteroaliphatic radical; and each of $K_1$, the linker, and $K_2$, also the linker, independently, is 0, S, Si, $C_1$-$C_6$ alkylene

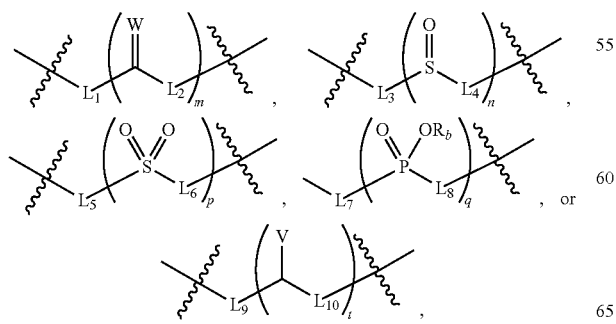

in which each of m, n, p, q, and t, independently, is 1-6; W is O, S, or $NR_c$; each of $L_1$, $L_3$, $L_5$, $L_7$, and $L_9$, independently, is a bond, O, S, or $NR_d$; each of L2, $L_4$, $L_6$, $L_5$, and $L_{10}$, independently, is a bond, O, S, or $NR_e$; and V is $OR_f$, $SR_g$, or $NR_hR_i$, each of $R_b$, $R_c$, $R_d$, $R_e$, $R_f$, $R_g$, $R_h$, and $R_i$, independently, being H, OH, a $C_1$-$C_{10}$ oxyaliphatic radical, a $C_1$-$C_{10}$ monovalent aliphatic radical, a $C_1$-$C_{10}$ monovalent heteroaliphatic radical, a monovalent aryl radical, or a monovalent heteroaryl radical and specific compounds:

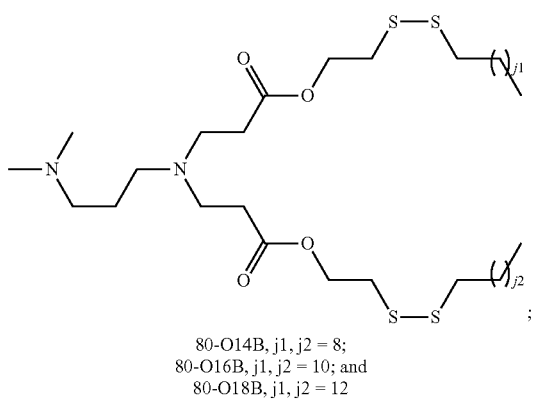

80-O14B, j1, j2 = 8;
80-O16B, j1, j2 = 10; and
80-O18B, j1, j2 = 12

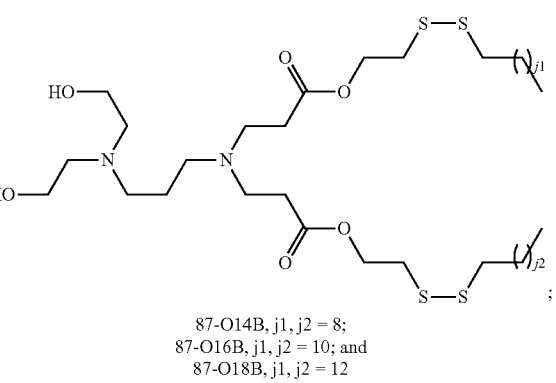

87-O14B, j1, j2 = 8;
87-O16B, j1, j2 = 10; and
87-O18B, j1, j2 = 12

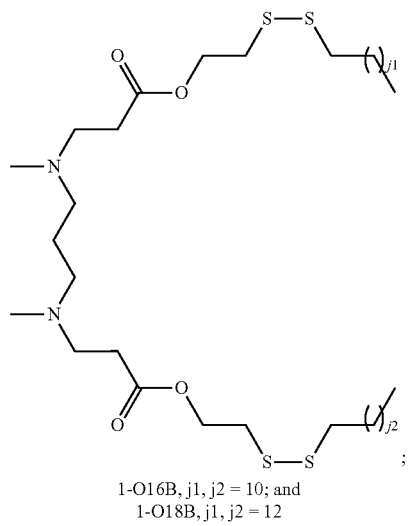

1-O16B, j1, j2 = 10; and
1-O18B, j1, j2 = 12

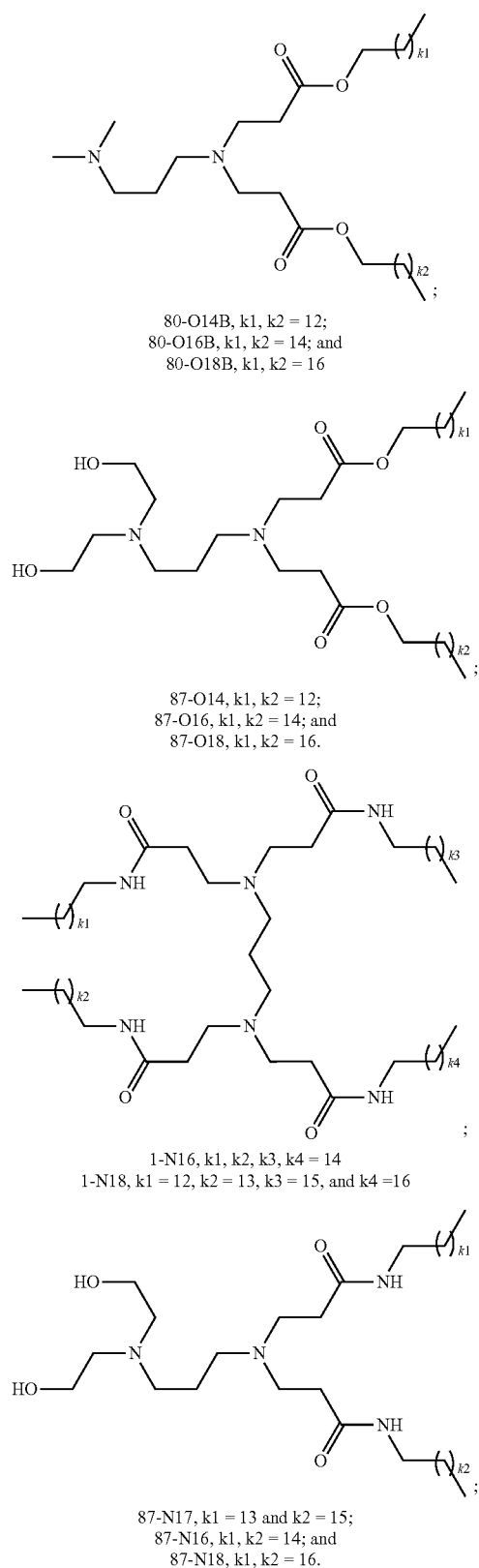
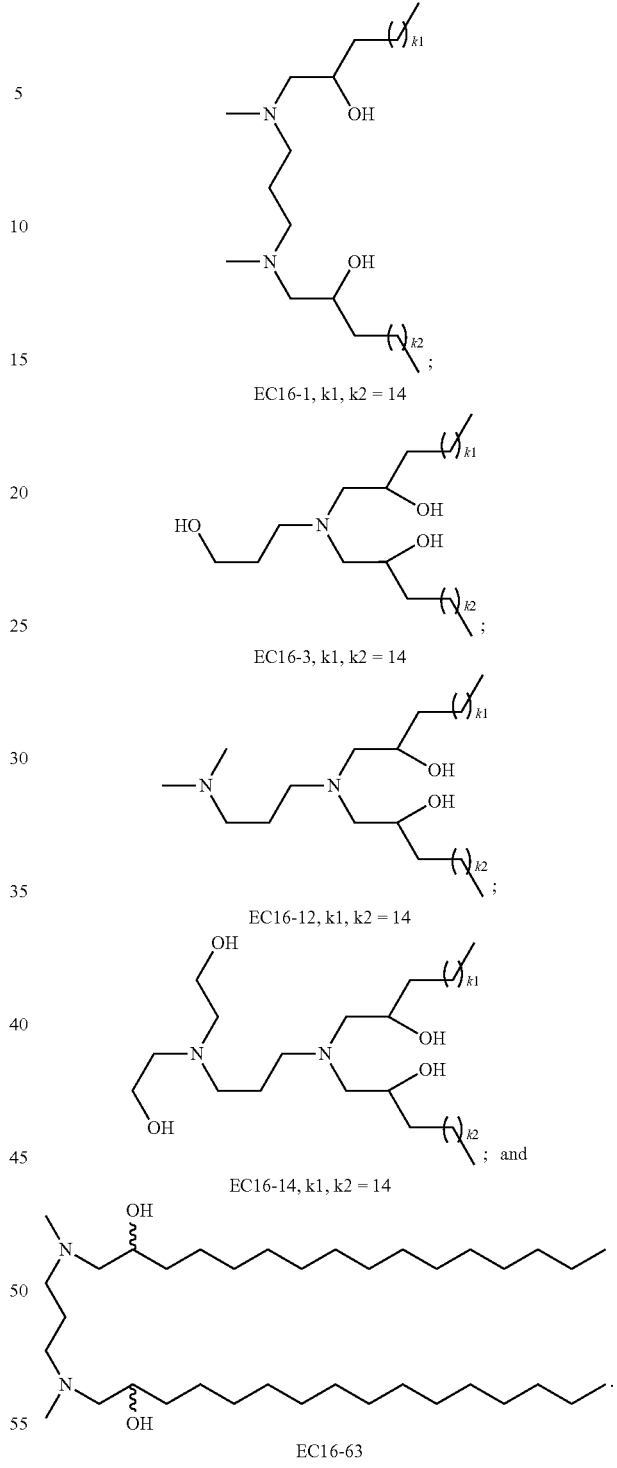
Additional examples of cationic lipid that can be used to make the particle delivery system of the invention can be found in US20150140070, wherein the cationic lipid has the formula

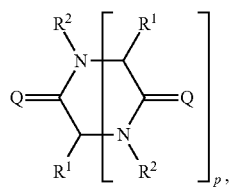

wherein p is an integer between 1 and 9, inclusive; each instance of Q is independently O, S, or $NR^Q$; $R^Q$ is hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, a nitrogen protecting group, or a group of the formula (i), (ii) or (iii); each instance of $R^1$ is independently hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, halogen, —$OR^{41}$, —$N(R^{41})_2$, —$SR^{41}$, or a group of formula:

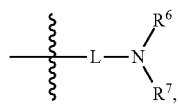

L is an optionally substituted alkylene, optionally substituted alkenylene, optionally substituted alkynylene, optionally substituted heteroalkylene, optionally substituted heteroalkenylene, optionally substituted heteroalkynylene, optionally substituted carbocyclylene, optionally substituted heterocyclylene, optionally substituted arylene, or optionally substituted heteroarylene, or combination thereof, and each of $R^6$ and $R^7$ is independently hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, a nitrogen protecting group, or a group of formula (i), (ii) or (iii); each occurrence of $R^{41}$ is independently hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, an oxygen protecting group when attached to an oxygen atom, a sulfur protecting group when attached to a sulfur atom, a nitrogen protecting group when attached to a nitrogen atom, or two $R^{41}$ groups, together with the nitrogen atom to which they are attached, are joined to form an optionally substituted heterocyclic or optionally substituted heteroaryl ring; each instance of $R^2$ is independently hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, a nitrogen protecting group, or a group of the formula (i), (ii), or (iii); Formulae (i), (ii), and (iii) are:

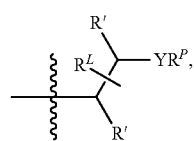

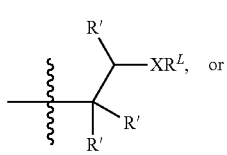

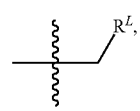

each instance of R' is independently hydrogen or optionally substituted alkyl; X is O, S, or NRX; RX is hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, or a nitrogen protecting group; Y is O, S, or NRY; RY is hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, or a nitrogen protecting group; RP is hydrogen, optionally substituted alkyl, optionally substituted alkenyl, optionally substituted alkynyl, optionally substituted carbocyclyl, optionally substituted heterocyclyl, optionally substituted aryl, optionally substituted heteroaryl, an oxygen protecting group when attached to an oxygen atom, a sulfur protecting group when attached to a sulfur atom, or a nitrogen protecting group when attached to a nitrogen atom; RL is optionally substituted C1-50 alkyl, optionally substituted C2-50 alkenyl, optionally substituted C2-50 alkynyl, optionally substituted hetero C1-50 alkyl, optionally substituted heteroC2-50 alkenyl, optionally substituted heteroC2-50 alkynyl, or a polymer; provided that at least one instance of RQ, R2, R6, or R7 is a group of the formula (i), (ii), or (iii); in Liu et al., (US 20160200779, US 20150118216, US 20150071903, and US 20150071903), which provide examples of cationic lipids to include polyethylenimine, polyamidoamine (PAMAM) starburst dendrimers, Lipofectin (a combination of DOTMA and DOPE), Lipofectase, LIPOFECTAMINE.RTM. (e.g., LIPOFECTAMINE.RTM. 2000, LIPOFECTAMINE.RTM. 3000, LIPOFECTAMINE.RTM. RNAiMAX, LIPOFECTAMINE.RTM. LTX), SAINT-RED (Synvolux Therapeutics, Groningen Netherlands), DOPE, Cytofectin (Gilead Sciences, Foster City, Calif.), and Eufectins (JBL, San Luis Obispo, Calif.). Exemplary cationic liposomes can be made from N-[1-(2,3-dioleoloxy)-propyl]-N,N,N-trimethylammonium chloride (DOTMA), N-[1-(2,3-dioleoloxy)-propyl]-N,N,N-trimethylammonium methylsulfate (DOTAP), 3.beta.-[N--(N',N'-dimethylaminoethane)carbamoyl]cholesterol (DC-Chol), 2,3,-dioleyloxy-N-[2(sperminecarboxamido)ethyl]-N,N-dimethyl-1-propanamin-ium trifluoroacetate (DOSPA), 1,2-dimyristyloxypropyl-3-dimethyl-hydroxyethyl ammonium bromide; and dimethyldioctadecylammonium bromide (DDAB); in WO2013/093648 which provides cationic lipids of formula

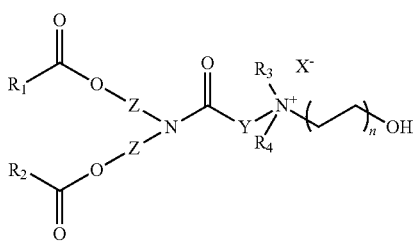

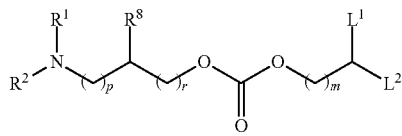

in which Z=an alkyl linker, $C_2$-$C_4$ alkyl, Y=an alkyl linker, $C_1$-$C_6$ alkyl, $R_1$ and $R_2$ are each independently $C_{10}$-$C_{30}$ alkyl, $C_{10}$-$C_{30}$ alkenyl, or $C_{10}$-$C_{30}$ alkynyl, $C_{10}$-$C_{30}$ alkyl, $C_{10}$-$C_{20}$ alkyl, $C_{12}$-$C_{15}$ alkyl, $C_{13}$-$C_{17}$alkyl, $C_{13}$alkyl, $C_{10}$-$C_{30}$ alkenyl, $C_{10}$-$C_{20}$alkenyl. $C_{12}$-$C_{15}$ alkenyl, $C_{13}$-$C_{17}$alkenyl, $C_{17}$alkenyl; $R^3$ and $R^4$ are each independently hydrogen, $C_1$-$C_6$ alkyl, or —$CH_2CH_2OH$, $C_1$-$C_6$ alkyl, $C_1$-$C_3$alkyl; n is 1-6; and X is a counterion, including any nitrogen counterion, as that term is readily understood in the art, and specific cationic lipids including pharmacologically acceptable salt thereof, wherein $R^1$ and $R^2$ are each independently a hydrogen atom, a $C_1$-$C_6$ alkyl group optionally substituted with one or more substituents selected from substituent group α, a $C_2$-$C_6$ alkenyl group optionally substituted with one or more substituents selected from substituent group α, a $C_2$-$C_6$ alkynyl group optionally substituted with one or more substituents selected from substituent group α, or a $C_3$-$C_7$ cycloalkyl group optionally substituted with one or more substituents selected from

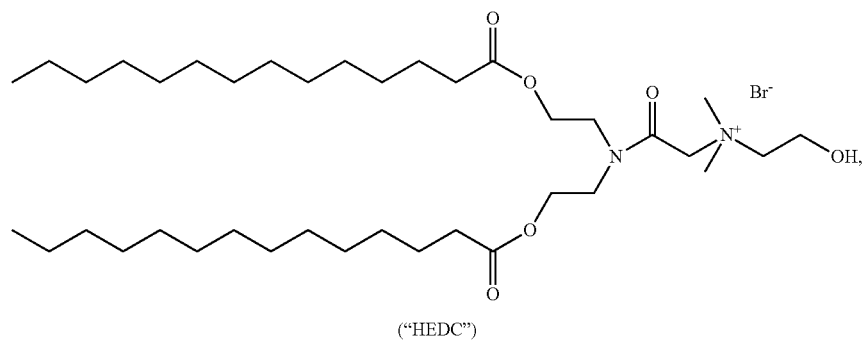

("HEDC")

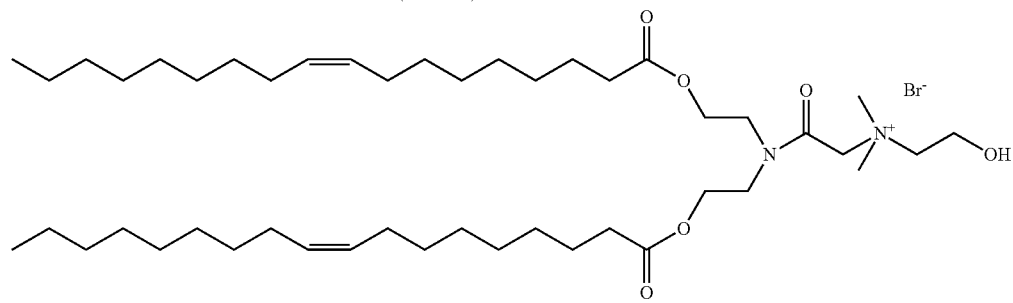

and ("HEDODC")

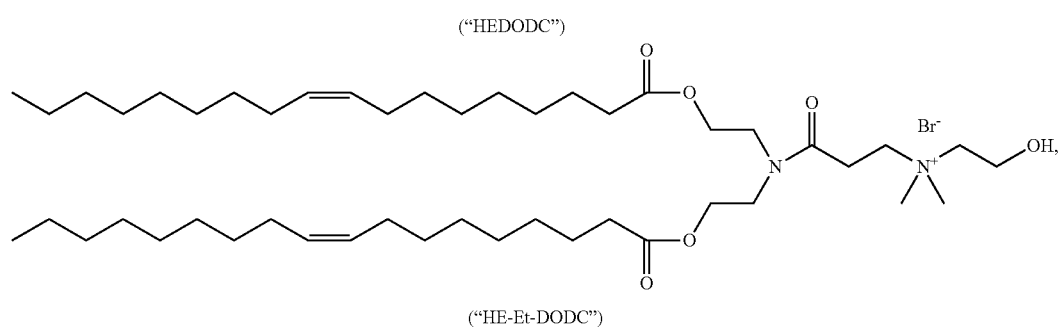

("HE-Et-DODC")

WO2013/093648 also provides examples of other cationic charged lipids at physiological pH including N,N-dioleyl-N,N-dimethylammonium chloride (DODAC), N,N-distearyl-N,N-dimethylammonium bromide (DDAB); N-(1,2-dimyristyloxyprop-3-yl)-N,N-dimethyl-N-hydroxyethylammonium bromide (DMRIE) and dioctadecylamidoglycyl carboxyspermidine (DOGS); in US 20160257951, which provides cationic lipids with a general formula or a substituent group α, or $R^1$ and $R^2$ form a 3- to 10-membered heterocyclic ring together with the nitrogen atom bonded thereto, wherein the heterocyclic ring is optionally substituted with one or more substituents selected from substituent group α and optionally contains one or more atoms selected from a nitrogen atom, an oxygen atom, and a sulfur atom, in addition to the nitrogen atom bonded to $R^1$ and $R^2$, as atoms constituting the heterocyclic ring; $R^8$ is a hydrogen atom or a $C_1$-$C_6$ alkyl group optionally substituted with one or more substituents selected from substituent group α; or $R^1$ and $R^8$ together are the group —$(CH_2)_q$—; substituent group α consists of a halogen atom, an oxo group, a hydroxy group, a sulfanyl group, an amino group, a cyano group, a $C_1$-$C_6$ alkyl group, a $C_1$-$C_6$ halogenated alkyl group, a $C_1$-$C_6$ alkoxy group, a $C_1$-$C_6$ alkylsulfanyl group, a $C_1$-$C_6$ alkylamino group, and a $C_1$-$C_7$ alkanoyl group; $L^1$ is a $C_{10}$-$C_{24}$ alkyl group optionally substituted with one or more substituents selected from substituent group β31, a $C_{10}$-$C_{24}$ alkenyl group optionally substituted with one or more substituents selected from substituent group β1, a $C_3$-$C_{24}$ alkynyl group optionally substituted with one or more substituents selected from substituent group β1, or a ($C_1$-$C_{10}$ alkyl)-$(Q)_k$-($C_1$-$C_{10}$ alkyl) group optionally substituted with one or more substituents selected from substituent group β1; $L^2$ is, independently of $L^1$, a $C_{10}$-$C_{24}$ alkyl group optionally substituted with one or more substituents selected from substituent group β1, a $C_{10}$-$C_{24}$ alkenyl group optionally substituted with one or more substituents selected from substituent group β1, a $C_3$-$C_{24}$ alkynyl group optionally substituted with one or more substituents selected from substituent group β1, a ($C_1$-$C_{10}$ alkyl)-$(Q)_k$-($C_1$-$C_{10}$ alkyl) group optionally substituted with having one or more substituents selected from substituent group β1, a ($C_{10}$-$C_{24}$ alkoxy)methyl group optionally substituted with one or more substituents selected from substituent group β1, a ($C_{10}$-$C_{24}$ alkenyl)oxymethyl group optionally substituted with one or more substituents selected from substituent group β1, a ($C_3$-$C_{24}$ alkynyl)oxymethyl group optionally substituted with one or more substituents selected from substituent group β1, or a ($C_1$-$C_{10}$ alkyl)-$(Q)_k$-($C_1$-$C_{10}$ alkoxy)methyl group optionally substituted with one or more substituents selected from substituent group β1; substituent group β1 consists of a halogen atom, an oxo group, a cyano group, a $C_1$-$C_6$ alkyl group, a $C_1$-$C_6$ halogenated alkyl group, a $C_1$-$C_6$ alkoxy group, a $C_1$-$C_6$ alkylsulfanyl group, a $C_1$-$C_7$ alkanoyl group, a $C_1$-$C_7$ alkanoyloxy group, a $C_3$-$C_7$ alkoxyalkoxy group, a ($C_1$-$C_6$ alkoxy)carbonyl group, a ($C_1$-$C_6$ alkoxy)carboxyl group, a ($C_1$-$C_6$ alkoxy)carbamoyl group, and a ($C_1$-$C_6$ alkylamino)carboxyl group; Q is a group of formula:

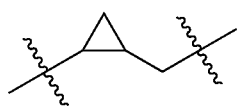 [SMILES: *CC1CC1*]

when $L^1$ and $L^2$ are each substituted with one or more substituents selected from substituent group β1 and substituent group β1 is a $C_1$-$C_6$ alkyl group, a $C_1$-$C_6$ alkoxy group, a $C_1$-$C_6$ alkylsulfanyl group, a $C_1$-$C_7$ alkanoyl group, or a $C_1$-$C_7$ alkanoyloxy group, the substituent or substituents selected from substituent group β1 in $L^1$ and the substituent or substituents selected from substituent group β31 in $L^2$ optionally bind to each other to form a cyclic structure; k is 1, 2, 3, 4, 5, 6, or 7; m is 0 or 1; p is 0, 1, or 2; q is 1, 2, 3, or 4; and r is 0, 1, 2, or 3, provided that p+r is 2 or larger, or q+r is 2 or larger, and specific cationic lipids including

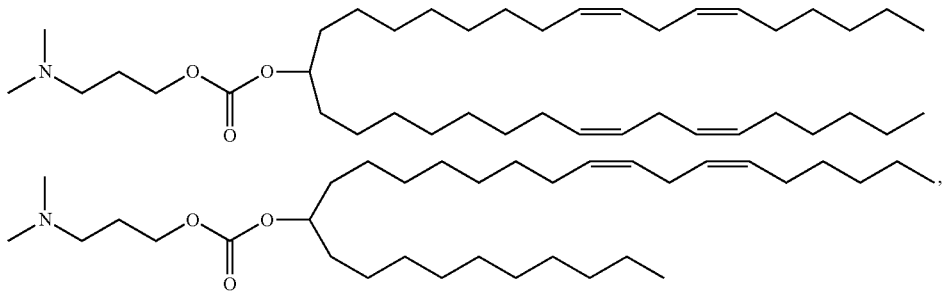

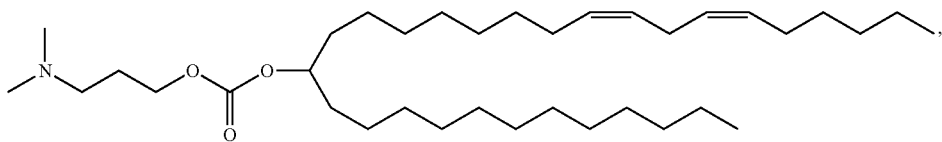

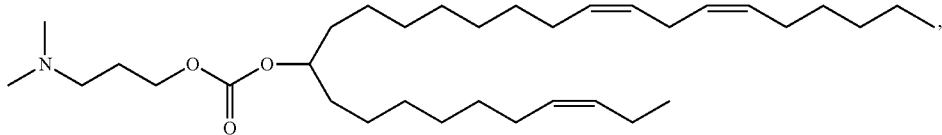

-continued

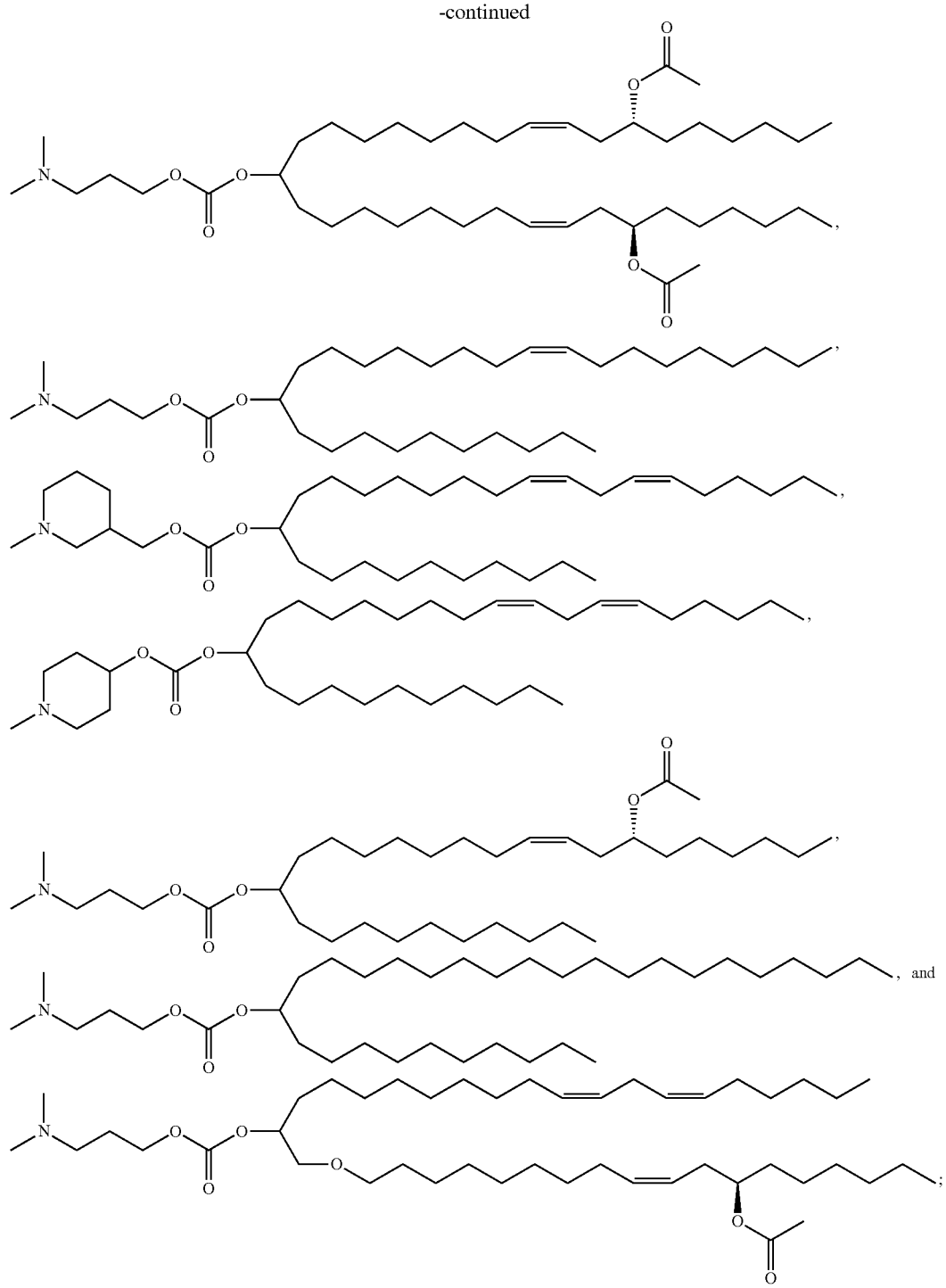

and in US 20160244761, which provides cationic lipids that include 1,2-distearyloxy-N,N-dimethyl-3-aminopropane (DSDMA), 1,2-dioleyloxy-N,N-dimethyl-3-aminopropane (DODMA), 1,2-dilinoleyloxy-N,N-dimethyl-3-aminopropane (DLinDMA), 1,2-dilinolenyloxy-N,N-dimethyl-3-aminopropane (DLenDMA), 1,2-di-.gamma.-linolenyloxy-N,N-dimethylaminopropane (.gamma.-DLenDMA), 1,2-dilinoleyloxy-keto-N,N-dimethyl-3-aminopropane (DLin-K-DMA), 1,2-dilinoleyl-4-(2-dimethylaminoethyl)-[1,3]-dioxolane (DLin-K--$C_2$-DMA) (also known as DLin-$C_2$K-DMA, XTC2, and $C_2$K), 2,2-dilinoleyl-4-(3-dimethylaminopropyl)-[1,3]-dioxolane (DLin-K-$C_3$-DMA), 2,2-dilinoleyl-4-(4-dimethylaminobutyl)-[1,3]-dioxolane (DLin-K-$C_4$-DMA), 1,2-dilinolenyloxy-4-(2-dimethylaminoethyl)-[1,3]-dioxolane (DLen-$C_2$K-DMA), 1,2-di-.gamma.-linolenyloxy-4-(2-dimethylaminoethyl)-[1,3]-dioxolane (.gamma.-DLen-$C_2$K-DMA), dilinoleylmethyl-3-dimethylaminopropionate (DLin-M-$C_2$-DMA) (also known as MC2), (6Z,9Z,28Z,31Z)-heptatriaconta-6,9,28,31-tetraen-19-yl 4-(dimethylamino) butanoate (DLin-M-$C_3$-

DMA) (also known as MC3) and 3-(dilinoleylmethoxy)-N,N-dimethylpropan-1-amine (DLin-MP-DMA) (also known as 1-B1 1).

In one embodiment, the lipid compound is preferably a bio-reducible material, e.g., a bio-reducible polymer and a bio-reducible lipid-like compound.

In embodiment, the lipid compound comprises a hydrophilic head, and a hydrophobic tail, and optionally a linker.

In one embodiment, the hydrophilic head contains one or more hydrophilic functional groups, e.g., hydroxyl, carboxyl, amino, sulfhydryl, phosphate, amide, ester, ether, carbamate, carbonate, carbamide and phosphodiester. These groups can form hydrogen bonds and are optionally positively or negatively charged, in particular at physiological conditions such as physiological pH.

In one embodiment, the hydrophobic tail is a saturated or unsaturated, linear or branched, acyclic or cyclic, aromatic or nonaromatic hydrocarbon moiety, wherein the saturated or unsaturated, linear or branched, acyclic or cyclic, aromatic or nonaromatic hydrocarbon moiety optionally contains a disulfide bond and/or 8-24 carbon atoms. One or more of the carbon atoms can be replaced with a heteroatom, such as N, O, P, B, S, Si, Sb, Al, Sn, As, Se, and Ge. The lipid or lipid-like compounds containing disulfide bond can be bioreducible.

In one embodiment, the linker of the lipid or lipid-like compound links the hydrophilic head and the hydrophobic tail. The linker can be any chemical group that is hydrophilic or hydrophobic, polar or non-polar, e.g., O, S, Si, amino, alkylene, ester, amide, carbamate, carbamide, carbonate phosphate, phosphite, sulfate, sulfite, and thiosulfate.

The lipid or lipid-like compounds described above include the compounds themselves, as well as their salts and solvates, if applicable. A salt, for example, can be formed between an anion and a positively charged group (e.g., amino) on a lipid-like compound. Suitable anions include chloride, bromide, iodide, sulfate, nitrate, phosphate, citrate, methanesulfonate, trifluoroacetate, acetate, malate, tosylate, tartrate, fumarate, glutamate, glucuronate, lactate, glutarate, and maleate. Likewise, a salt can also be formed between a cation and a negatively charged group (e.g., carboxylate) on a lipid-like compound. Suitable cations include sodium ion, potassium ion, magnesium ion, calcium ion, and an ammonium cation such as tetramethylammonium ion. The lipid-like compounds also include those salts containing quaternary nitrogen atoms. A solvate refers to a complex formed between a lipid-like compound and a pharmaceutically acceptable solvent. Examples of pharmaceutically acceptable solvents include water, ethanol, isopropanol, ethyl acetate, acetic acid, and ethanolamine.

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the CRISPR Cas system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific CRISPR Cas targeted in a SNALP are contemplated. The daily treatment may be over about three days and then weekly for about five weeks. In another embodiment, a specific CRISPR Cas encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly (ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., $L^1$, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol) 2000)carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total CRISPR Cas per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardio-myopathy (FAC) both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at >0.4 mg/kg; all responded to slowing of the infusion rate and all continued on study. Minimal and transient elevations of serum cytokines IL-6, IP-10 and IL-Ira were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Niotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 m filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the CRISPR Cas system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate CRISPR Cas or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11+0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the CRISPR Cas system of the present invention or component (s) thereof or nucleic acid molecule(s) coding therefor to form lipid nanoparticles (LNPs). Lipids include, but are not limited to, DLin-KC2-DMA4, $C_{12}$-200 and colipids disteroylphosphatidyl choline, cholesterol, and PEG-DMG may be formulated with CRISPR Cas instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or $C_{12}$-200/disteroylphosphatidyl choline/cholesterol/PEG-DMG). The final lipid:siRNA weight ratio may be -12:1 and 9:1 in the case of DLin-KC2-DMA and $C_{12}$-200 lipid nanoparticles (LNPs), respectively. The formulations may have mean particle diameters of −80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The CRISPR Cas system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesised from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P($O_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of CRISPR Cas system(s) or component(s) thereof or nucleic acid molecule(s) coding therefor.

Additional delivery system formulations and particle types are also contemplated. In one embodiment, plasmids containing Cas9 and gRNA sequences can be delivered in a formulation that includes polyethyleneimine (PEI), specifically branched PEI 25 kD. See, e.g. Ryu et al., "Effective PEI-mediated delivery of CRISPR-Cas9 complex for targeted gene therapy" Nanomedicine. 2018 October;14(7): 2095-2102. In another embodiment, plasmids can be delivered in a formulation in which the plasmids are complexed with stearyl polyethylenimine as the core of human serum albumin nanoparticles noncovalently bound to CRISPR/Cas9 plasmids or siRNA for disrupting or silencing PD-L[1] expression for immunotherapy. See, e.g. Cheng et al., Int J Nanomedicine. 2018 Nov. 2; 13:7079-7094. 2018. In another embodiment, plasmids containing Cas9 and gRNA sequences can be delivered in a hybrid nanoparticle produced by encapsulating the plasmid in an exosome, which is then fused with a liposome, to allow uptake by cell types that are not efficiently transfected using liposomes. See, e.g. Lin et al., "Exosome-Liposome Hybrid Nanoparticles Deliver CRISPR/Cas9 System in MSCs" Adv Sci (Weinh). 2018 April; 5(4): 1700611. In another embodiment, a Cas9 plasmid can be delivered in a formulation that includes a novel fluorinated acid-labile branched hydroxyl-rich polycation (ARP-F). See, e.g. Qi et al., "Fluorinated Acid-Labile Branched Hydroxyl-Rich Nanosystems for Flexible and Robust Delivery of Plasmids." Small. 2018 October;14(42): e1803061.

Supercharged Proteins

Supercharged proteins are a class of engineered or naturally occurring proteins with unusually high positive or negative net theoretical charge and may be employed in delivery of CRISPR Cas system(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified+36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA $10^6$, 6111-6116) (However, pilot experiments varying the dose of protein and RNA should be performed to optimize the procedure for specific cell lines):

(1) One day before treatment, plate $1\times10^5$ cells per well in a 48-well plate.

(2) On the day of treatment, dilute purified+36 GFP protein in serumfree media to a final concentration 200 nM. Add RNA to a final concentration of 50 nM. Vortex to mix and incubate at room temperature for 10 min.

(3) During incubation, aspirate media from cells and wash once with PBS.

(4) Following incubation of +36 GFP and RNA, add the protein-RNA complexes to cells.

(5) Incubate cells with complexes at 37° C. for 4 h.

(6) Following incubation, aspirate the media and wash three times with 20 U/mL heparin PBS. Incubate cells with serum-containing media for a further 48 h or longer depending upon the assay for activity.

(7) Analyze cells by immunoblot, qPCR, phenotypic assay, or other appropriate method.

David Liu's lab has further found+36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications:

(1) One day before treatment, plate $1\times10^5$ per well in a 48-well plate. (2) On the day of treatment, dilute purified 36 GFP protein in serumfree media to a final concentration 2 mM. Add 1 mg of plasmid DNA. Vortex to mix and incubate at room temperature for 10 min.

(3) During incubation, aspirate media from cells and wash once with PBS.

(4) Following incubation of 36 GFP and plasmid DNA, gently add the protein-DNA complexes to cells.

(5) Incubate cells with complexes at 37 C for 4 h.

(6) Following incubation, aspirate the media and wash with PBS. Incubate cells in serum-containing media and incubate for a further 24-48 h.

(7) Analyze plasmid delivery (e.g., by plasmid-driven gene expression) as appropriate.

See also, e.g., McNaughton et al., Proc. Natl. Acad. Sci. USA $10^6$, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the CRISPR Cas system of the present invention. These systems of Dr. Lui and documents herein in conjunction with herein teaching can be employed in the delivery of CRISPR Cas system(s) or component(s) thereof or nucleic acid molecule(s) coding therefor.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles, including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs is to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951 provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. No. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Implantable Devices

In another embodiment, implantable devices are also contemplated for delivery of the CRISPR Cas system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used/and or adapted to the CRISPR Cas system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure.

US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 m$^3$ to 1000 mm$^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example the composition (optionally with the device) is optionally implanted within or in the proximity to pancreas, prostate, breast, liver, via the nipple, within the vascular system and so forth.

The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear--auditory system, labyrinth of the inner ear, vestibular system; 11. Intra tracheal; 12. Intracardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to other embodiments of US Patent Publication 20110195123, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the CRISPR Cas system of the present invention.

As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the CRISPR Cas system of the present invention.

As yet another example of a specific application, psychiatric and cognitive disorders are treated with gene modifiers. Gene knockdown is a treatment option. Loders locally delivering agents to central nervous system sites are therapeutic options for psychiatric and cognitive disorders including but not limited to psychosis, bi-polar diseases, neurotic disorders and behavioral maladies. The Loders could also deliver locally drugs including small drugs and macromolecules upon implantation at specific brain sites. All of this may be used and/or adapted to the CRISPR Cas system of the present invention.

As another example of a specific application, silencing of innate and/or adaptive immune mediators at local sites enables the prevention of organ transplant rejection. Local delivery of RNAs and immunomodulating reagents with the Loder implanted into the transplanted organ and/or the implanted site renders local immune suppression by repelling immune cells such as CD8 activated against the transplanted organ. All of this may be used/and or adapted to the CRISPR Cas system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules and small drugs stimulating angiogenesis with the Loder is therapeutic for peripheral, systemic and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

Implantable devices may also include cells, such as epidermal progenitor cells that have been edited or modified to express the CRISPR-Cas systems disclosed herein and embedded with an implantable device, such as a patch. See. Yue et al. "Engineered Epidermal Progenitor Cells Can Correct Diet-Induced Obesity and Diabetes" Cell Stem Cell (2017) 21(2):256-263.

Implantable device technology herein discussed can be employed with herein teachings and hence by this disclosure and the knowledge in the art, CRISPR-Cas system or components thereof or nucleic acid molecules thereof or encoding or providing components may be delivered via an implantable device.

Aerosol Delivery

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector.

Hybrid Viral Capsid Delivery Systems

In one aspect, the invention provides a particle delivery system comprising a hybrid virus capsid protein or hybrid viral outer protein, wherein the hybrid virus capsid or outer protein comprises a virus capsid or outer protein attached to at least a portion of a non-capsid protein or peptide. The genetic material of a virus is stored within a viral structure called the capsid. The capsid of certain viruses are enclosed in a membrane called the viral envelope. The viral envelope is made up of a lipid bilayer embedded with viral proteins including viral glycoproteins. As used herein, an "envelope protein" or "outer protein" means a protein exposed at the surface of a viral particle that is not a capsid protein. For example envelope or outer proteins typically comprise proteins embedded in the envelope of the virus. Non-limiting examples of outer or envelope proteins include, without limit, gp41 and gp120 of HIV, hemagglutinin, neuraminidase and M2 proteins of influenza virus.

In one example embodiment of the delivery system, the non-capsid protein or peptide has a molecular weight of up to a megadalton, or has a molecular weight in the range of 110 to 160 kDa, 160 to 200 kDa, 200 to 250 kDa, 250 to 300 kDa, 300 to 400 kDa, or 400 to 500 kDa, the non-capsid protein or peptide comprises a CRISPR protein.

The present application provides a vector for delivering an effector protein and at least one CRISPR guide RNA to a cell comprising a minimal promoter operably linked to a polynucleotide sequence encoding the effector protein and a second minimal promoter operably linked to a polynucleotide sequence encoding at least one guide RNA, wherein the length of the vector sequence comprising the minimal promoters and polynucleotide sequences is less than 4.4 Kb. In an embodiment, the virus is an adeno-associated virus (AAV) or an adenovirus. In another embodiment, the effector protein is a CRISPR anzyme. In a further embodiment, the CRISPR enzyme is SaCas9, Cpf1, Cas13b or C2c2.

In a related aspect, the invention provides a lentiviral vector for delivering an effector protein and at least one CRISPR guide RNA to a cell comprising a promoter operably linked to a polynucleotide sequence encoding Cas and a second promoter operably linked to a polynucleotide sequence encoding at least one guide RNA, wherein the polynucleotide sequences are in reverse orientation.

In an embodiment of the delivery system, the virus is lentivirus or murine leukemia virus (MuMLV).

In an embodiment of the delivery system, the virus is an Adenoviridae or a Parvoviridae or a retrovirus or a Rhabdoviridae or an enveloped virus having a glycoprotein protein (G protein).

In an embodiment of the delivery system, the virus is VSV or rabies virus.

In an embodiment of the delivery system, the capsid or outer protein comprises a capsid protein having VP1, VP2 or VP3.

In an embodiment of the delivery system, the capsid protein is VP3, and the non-capsid protein is inserted into or attached to VP3 loop 3 or loop 6.

In an embodiment of the delivery system, the virus is delivered to the interior of a cell.

In an embodiment of the delivery system, the capsid or outer protein and the non-capsid protein can dissociate after delivery into a cell.

In an embodiment of the delivery system, the capsid or outer protein is attached to the protein by a linker.

In an embodiment of the delivery system, the linker comprises amino acids.

In an embodiment of the delivery system, the linker is a chemical linker.

In an embodiment of the delivery system, the linker is cleavable.

In an embodiment of the delivery system, the linker is biodegradable.

In an embodiment of the delivery system, the linker comprises (GGGGS)1-3 (SEQ ID NO: 210-211, 198), ENLYFQG (SEQ ID NO:255), or a disulfide.

In an embodiment, the delivery system comprises a protease or nucleic acid molecule(s) encoding a protease that is expressed, said protease being capable of cleaving the linker, whereby there can be cleavage of the linker. In an embodiment of the invention, a protease is delivered with a particle component of the system, for example packaged, mixed with, or enclosed by lipid and or capsid. Entry of the particle into a cell is thereby accompanied or followed by cleavage and dissociation of payload from particle. In certain embodiments, an expressible nucleic acid encoding a protease is delivered, whereby at entry or following entry of the particle into a cell, there is protease expression, linker cleavage, and dissociation of payload from capsid. In certain embodiments, dissociation of payload occurs with viral replication. In certain embodiments, dissociation of payload occurs in the absence of productive virus replication.

In an embodiment of the delivery system, each terminus of a CRISPR protein is attached to the capsid or outer protein by a linker.

In an embodiment of the delivery system, the non-capsid protein is attached to the exterior portion of the capsid or outer protein.

In an embodiment of the delivery system, the non-capsid protein is attached to the interior portion of the capsid or outer protein.

In an embodiment of the delivery system, the capsid or outer protein and the non-capsid protein are a fusion protein.

In an embodiment of the delivery system, the non-capsid protein is encapsulated by the capsid or outer protein.

In an embodiment of the delivery system, the non-capsid protein is attached to a component of the capsid protein or a component of the outer protein prior to formation of the capsid or the outer protein.

In an embodiment of the delivery system, the protein is attached to the capsid or outer protein after formation of the capsid or outer protein.

In an embodiment, the delivery system comprises a targeting moiety, such as active targeting of a lipid entity of the invention, e.g., lipid particle or nanoparticle or liposome or lipid bylayer of the invention comprising a targeting moiety for active targeting.

With regard to targeting moieties, mention is made of Deshpande et al, "Current trends in the use of liposomes for tumor targeting," Nanomedicine (Lond). 8(9), doi:10.2217/nnm.13.118 (2013), and the documents it cites, all of which are incorporated herein by reference. Mention is also made of WO/2016/027264, and the documents it cites, all of which are incorporated herein by reference. And mention is made of Lorenzer et al, "Going beyond the liver: Progress and challenges of targeted delivery of siRNA therapeutics," Journal of Controlled Release, 203: 1-15 (2015), , and the documents it cites, all of which are incorporated herein by reference.

An actively targeting lipid particle or nanoparticle or liposome or lipid bylayer delivery system (generally as to embodiments of the invention, "lipid entity of the invention" delivery systems) are prepared by conjugating targeting moieties, including small molecule ligands, peptides and monoclonal antibodies, on the lipid or liposomal surface; for example, certain receptors, such as folate and transferrin (Tf) receptors (TfR), are overexpressed on many cancer cells and have been used to make liposomes tumor cell specific. Liposomes that accumulate in the tumor microenvironment can be subsequently endocytosed into the cells by interacting with specific cell surface receptors. To efficiently target liposomes to cells, such as cancer cells, it is useful that the targeting moiety have an affinity for a cell surface receptor and to link the targeting moiety in sufficient quantities to have optimum affinity for the cell surface receptors; and determining these aspects are within the ambit of the skilled artisan. In the field of active targeting, there are a number of cell-, e.g., tumor-, specific targeting ligands.

Also as to active targeting, with regard to targeting cell surface receptors such as cancer cell surface receptors, targeting ligands on liposomes can provide attachment of liposomes to cells, e.g., vascular cells, via a noninternalizing epitope; and, this can increase the extracellular concentration of that which is being delivered, thereby increasing the amount delivered to the target cells. A strategy to target cell surface receptors, such as cell surface receptors on cancer cells, such as overexpressed cell surface receptors on cancer cells, is to use receptor-specific ligands or antibodies. Many cancer cell types display upregulation of tumor-specific receptors. For example, TfRs and folate receptors (FRs) are greatly overexpressed by many tumor cell types in response to their increased metabolic demand. Folic acid can be used as a targeting ligand for specialized delivery owing to its ease of conjugation to nanocarriers, its high affinity for FRs and the relatively low frequency of FRs, in normal tissues as compared with their overexpression in activated macrophages and cancer cells, e.g., certain ovarian, breast, lung, colon, kidney and brain tumors. Overexpression of FR on macrophages is an indication of inflammatory diseases, such as psoriasis, Crohn's disease, rheumatoid arthritis and atherosclerosis; accordingly, folate-mediated targeting of the invention can also be used for studying, addressing or treating inflammatory disorders, as well as cancers. Folate-linked lipid particles or nanoparticles or liposomes or lipid bylayers of the invention ("lipid entity of the invention") deliver their cargo intracellularly through receptor-mediated endocytosis. Intracellular trafficking can be directed to acidic compartments that facilitate cargo release, and, most importantly, release of the cargo can be altered or delayed until it reaches the cytoplasm or vicinity of target organelles. Delivery of cargo using a lipid entity of the invention having a targeting moiety, such as a folate-linked lipid entity of the invention, can be superior to nontargeted lipid entity of the invention. The attachment of folate directly to the lipid head groups may not be favorable for intracellular delivery of folate-conjugated lipid entity of the invention, since they may not bind as efficiently to cells as folate attached to the lipid entity of the invention surface by a spacer, which may can enter cancer cells more efficiently. A lipid entity of the invention coupled to folate can be used for the delivery of complexes of lipid, e.g., liposome, e.g., anionic liposome and virus or capsid or envelope or virus outer protein, such as those herein discussed such as adenovirous or AAV. Tf is a monomeric serum glycoprotein of approximately 80 KDa involved in the transport of iron throughout the body. Tf binds to the TfR and translocates into cells via receptor-mediated endocytosis. The expression of TfR can be higher in certain cells, such as tumor cells (as compared with normal cells and is associated with the increased iron demand in rapidly proliferating cancer cells. Accordingly, the invention comprehends a TfR-targeted lipid entity of the invention, e.g., as to liver cells, liver cancer, breast cells such as breast cancer cells, colon such as colon cancer cells, ovarian cells such as ovarian cancer cells, head, neck and lung cells, such as head, neck and non-small-cell lung cancer cells, cells of the mouth such as oral tumor cells.

Also as to active targeting, a lipid entity of the invention can be multifunctional, i.e., employ more than one targeting moiety such as CPP, along with Tf; a bifunctional system; e.g., a combination of Tf and poly-L-arginine which can provide transport across the endothelium of the blood-brain barrier. EGFR is a tyrosine kinase receptor belonging to the ErbB family of receptors that mediates cell growth, differentiation and repair in cells, especially non-cancerous cells, but EGF is overexpressed in certain cells such as many solid tumors, including colorectal, non-small-cell lung cancer, squamous cell carcinoma of the ovary, kidney, head, pancreas, neck and prostate, and especially breast cancer. The invention comprehends EGFR-targeted monoclonal antibody(ies) linked to a lipid entity of the invention. HER-2 is often overexpressed in patients with breast cancer, and is also associated with lung, bladder, prostate, brain and stomach cancers. HER-2, encoded by the ERBB2 gene. The invention comprehends a HER-2-targeting lipid entity of the invention, e.g., an anti-HER-2-antibody(or binding fragment thereof)-lipid entity of the invention, a HER-2-targeting-PEGylated lipid entity of the invention (e.g., having an anti-HER-2-antibody or binding fragment thereof), a HER-2-targeting-maleimide-PEG polymer-lipid entity of the invention (e.g., having an anti-HER-2-antibody or binding fragment thereof). Upon cellular association, the receptor-antibody complex can be internalized by formation of an endosome for delivery to the cytoplasm. With respect to receptor-mediated targeting, the skilled artisan takes into consideration ligand/target affinity and the quantity of receptors on the cell surface, and that PEGylation can act as a barrier against interaction with receptors. The use of antibody-lipid entity of the invention targeting can be advantageous. Multivalent presentation of targeting moieties can also increase the uptake and signaling properties of antibody fragments. In practice of the invention, the skilled person takes into account ligand density (e.g., high ligand densities on a lipid entity of the invention may be advantageous for increased binding to target cells). Preventing early by macrophages can be addressed with a sterically stabilized lipid entity of the invention and linking ligands to the terminus of molecules such as PEG, which is anchored in the lipid entity of the invention (e.g., lipid particle or nanoparticle or liposome or lipid bylayer). The microenvironment of a cell mass such as a tumor microenvironment can be targeted; for instance, it may be advantageous to target cell mass vasculature, such as the the tumor vasculature microenvironment. Thus, the invention comprehends targeting VEGF. VEGF and its receptors are well-known proangiogenic molecules and are well-characterized targets for antiangiogenic therapy. Many small-molecule inhibitors of receptor tyrosine kinases, such as VEGFRs or basic FGFRs, have been developed as anticancer agents and the invention comprehends coupling any one or more of these peptides to a lipid entity of the invention, e.g., phage IVO peptide(s) (e.g., via or with a PEG terminus), tumor-homing peptide APRPG (SEQ ID NO: 259) such as APRPG-PEG-modified (SEQ ID NO: 259). VCAM, the vascular endothelium plays a key role in the pathogenesis of inflammation, thrombosis and atherosclerosis. CAMs are involved in inflammatory disorders, including cancer, and are a logical target, E- and P-selectins, VCAM-1 and ICAMs. Can be used to target a lipid entity of the invention., e.g., with PEGylation. Matrix metalloproteases (MMPs) belong to the family of zinc-dependent endopeptidases. They are involved in tissue remodeling, tumor invasiveness, resistance to apoptosis and metastasis. There are four MMP inhibitors called TIMP1-4, which determine the balance between tumor growth inhibition and metastasis; a protein involved in the angiogenesis of tumor vessels is MT1-MMP, expressed on newly formed vessels and tumor tissues. The proteolytic activity of MT1-MMP cleaves proteins, such as fibronectin, elastin, collagen and laminin, at the plasma membrane and activates soluble MMPs, such as MMP-2, which degrades the matrix. An antibody or fragment thereof such as a Fab' fragment can be used in the practice of the invention such as for an antihuman MT1-MMP monoclonal antibody linked to a lipid entity of the invention, e.g., via a spacer such as a PEG spacer. a β-integrins or integrins are a group of transmembrane glycoprotein receptors that mediate attachment between a cell and its surrounding tissues or extracellular matrix. Integrins contain two distinct chains (heterodimers) called α- and β-subunits. The tumor tissue-specific expression of integrin receptors can be utilized for targeted delivery in the invention, e.g., whereby the targeting moiety can be an RGD peptide such as a cyclic RGD. Aptamers are ssDNA or RNA oligonucleotides that impart high affinity and specific recognition of the target molecules by electrostatic interactions, hydrogen bonding and hydro phobic interactions as opposed to the Watson-Crick base pairing, which is typical for the bonding interactions of oligonucleotides. Aptamers as a targeting moiety can have advantages over antibodies: aptamers can demonstrate higher target antigen recognition as compared with antibodies; aptamers can be more stable and smaller in size as compared with antibodies; aptamers can be easily synthesized and chemically modified for molecular conjugation; and aptamers can be changed in sequence for improved selectivity and can be developed to recognize poorly immunogenic targets. Such moieties as a sgc8 aptamer can be used as a targeting moiety (e.g., via covalent linking to the lipid entity of the invention, e.g., via a spacer, such as a PEG spacer). The targeting moiety can be stimuli-sensitive, e.g., sensitive to an externally applied stimuli, such as magnetic fields, ultrasound or light; and pH-triggering can also be used, e.g., a labile linkage can be used between a hydrophilic moiety such as PEG and a hydrophobic moiety such as a lipid entity of the invention, which is cleaved only upon exposure to the relatively acidic conditions characteristic of the a particular environment or microenvironment such as an endocytic vacuole or the acidotic tumor mass. pH-sensitive copolymers can also be incorporated in embodiments of the invention can provide shielding; diortho esters, vinyl esters, cysteine-cleavable lipopolymers, double esters and hydrazones are a few examples of pH-sensitive bonds that are quite stable at pH 7.5, but are hydrolyzed relatively rapidly at pH 6 and below, e.g., a terminally alkylated copolymer of N-isopropylacrylamide and methacrylic acid that copolymer facilitates destabilization of a lipid entity of the invention and release in compartments with decreased pH value; or, the invention comprehends ionic polymers for generation of a pH-responsive lipid entity of the invention (e.g., poly(methacrylic acid), poly(diethylaminoethyl methacrylate), poly(acrylamide) and poly(acrylic acid)). Temperature-triggered delivery is also within the ambit of the invention. Many pathological areas, such as inflamed tissues and tumors, show a distinctive hyperthermia compared with normal tissues. Utilizing this hyperthermia is an attractive strategy in cancer therapy since hyperthermia is associated with increased tumor permeability and enhanced uptake. This technique involves local heating of the site to increase microvascular pore size and blood flow, which, in turn, can result in an increased extravasation of embodiments of the invention. Temperature-sensitive lipid entity of the invention can be prepared from thermosensitive lipids or polymers with a low critical solution temperature. Above the low critical solution temperature (e.g., at site such as tumor site or inflamed tissue site), the polymer precipitates, disrupting the liposomes to release. Lipids with a specific gel-to-liquid phase transition temperature are used to prepare these lipid entities of the invention; and a lipid for a thermosensitive embodiment can be dipalmitoylphosphatidylcholine. Thermosensitive polymers can also facilitate destabilization followed by release, and a useful thermosensitive polymer is poly (N-isopropylacrylamide). Another temperature triggered system can employ lysolipid temperature-sensitive liposomes. The invention also comprehends redox-triggered delivery: The difference in redox potential between normal and inflamed or tumor tissues, and between the intra- and extra-cellular environments has been exploited for delivery; e.g., GSH is a reducing agent abundant in cells, especially in the cytosol, mitochondria and nucleus. The GSH concentrations in blood and extracellular matrix are just one out of 100 to one out of 1000 of the intracellular concentration, respectively. This high redox potential difference caused by GSH, cysteine and other reducing agents can break the reducible bonds, destabilize a lipid entity of the invention and result in release of payload. The disulfide bond can be used as the cleavable/reversible linker in a lipid entity of the invention, because it causes sensitivity to redox owing to the disulfideto-thiol reduction reaction; a lipid entity of the invention can be made reduction sensitive by using two (e.g., two forms of a disulfide-conjugated multifunctional lipid as cleavage of the disulfide bond (e.g., via tris(2-carboxyethyl)phosphine, dithiothreitol, L-cysteine or GSH), can cause removal of the hydrophilic head group of the conjugate and alter the membrane organization leading to release of payload. Calcein release from reduction-sensitive lipid entity of the invention containing a disulfide conjugate can be more useful than a reduction-insensitive embodiment. Enzymes can also be used as a trigger to release payload. Enzymes, including MMPs (e.g. MMP2), phospholipase A2, alkaline phosphatase, transglutaminase or phosphatidylinositol-specific phospholipase C, have been found to be overexpressed in certain tissues, e.g., tumor tissues. In the presence of these enzymes, specially engineered enzyme-sensitive lipid entity of the invention can be disrupted and release the payload. an MMP2-cleavable octapeptide (Gly-Pro-Leu-Gly-Ile-Ala-Gly-Gln) (SEQ ID NO: 260) can be incorporated into a linker, and can have antibody targeting, e.g., antibody 2C5. The invention also comprehends light- or energy-triggered delivery, e.g., the lipid entity of the invention can be light-sensitive, such that light or energy can facilitate structural and conformational changes, which lead to direct interaction of the lipid entity of the invention with the target cells via membrane fusion, photo-isomerism, photofragmentation or photopolymerization; such a moiety therefor can be benzoporphyrin photosensitizer. Ultrasound can be a form of energy to trigger delivery; a lipid entity of the invention with a small quantity of particular gas, including air or perfluorated hydrocarbon can be triggered to release with ultrasound, e.g., low-frequency ultrasound (LFUS). Magnetic delivery: A lipid entity of the invention can be magnetized by incorporation of magnetites, such as Fe3O4 or γ-Fe2O3, e.g., those that are less than 10 nm in size. Targeted delivery can be then by exposure to a magnetic field.

Also as to active targeting, the invention also comprehends intracellular delivery. Since liposomes follow the endocytic pathway, they are entrapped in the endosomes (pH 6.5-6) and subsequently fuse with lysosomes (pH<5), where they undergo degradation that results in a lower therapeutic potential. The low endosomal pH can be taken advantage of to escape degradation. Fusogenic lipids or peptides, which destabilize the endosomal membrane after the conformational transition/activation at a lowered pH. Amines are protonated at an acidic pH and cause endosomal swelling and rupture by a buffer effect Unsaturated dioleoylphosphatidylethanolamine (DOPE) readily adopts an inverted hexagonal shape at a low pH, which causes fusion of liposomes to the endosomal membrane. This process destabilizes a lipid entity containing DOPE and releases the cargo into the cytoplasm; fusogenic lipid GALA (SEQ ID NO: 261), cholesteryl-GALA (SEQ ID NO: 261) and PEG-GALA (SEQ ID NO: 261) may show a highly efficient endosomal release; a pore-forming protein listeriolysin O may provide an endosomal escape mechanism; and, histidine-rich peptides have the ability to fuse with the endosomal membrane, resulting in pore formation, and can buffer the proton pump causing membrane lysis.

Also as to active targeting, cell-penetrating peptides (CPPs) facilitate uptake of macromolecules through cellular membranes and, thus, enhance the delivery of CPP-modified molecules inside the cell. CPPs can be split into two classes: amphipathic helical peptides, such as transportan and MAP, where lysine residues are major contributors to the positive charge; and Arg-rich peptides, such as TATp, Antennapedia or penetratin. TATp is a transcription-activating factor with 86 amino acids that contains a highly basic (two Lys and six Arg among nine residues) protein transduction domain, which brings about nuclear localization and RNA binding. Other CPPs that have been used for the modification of liposomes include the following: the minimal protein transduction domain of Antennapedia, a Drosophilia homeoprotein, called penetratin, which is a 16-mer peptide (residues 43-58) present in the third helix of the homeodomain; a 27-amino acid-long chimeric CPP, containing the peptide sequence from the amino terminus of the neuropeptide galanin bound via the Lys residue, mastoparan, a wasp venom peptide; VP22, a major structural component of HSV-1 facilitating intracellular transport and transportan (18-mer) amphipathic model peptide that translocates plasma membranes of mast cells and endothelial cells by both energy-dependent and -independent mechanisms. The invention comprehends a lipid entity of the invention modified with CPP(s), for intracellular delivery that may proceed via energy dependent macropinocytosis followed by endosomal escape. The invention further comprehends organelle-specific targeting. A lipid entity of the invention surface-functionalized with the triphenylphosphonium (TPP) moiety or a lipid entity of the invention with a lipophilic cation, rhodamine 123 can be effective in delivery of cargo to mitochondria. DOPE/sphingomyelin/stearyl-octa-arginine can delivers cargos to the mitochondrial interior via membrane fusion. A lipid entity of the invention surface modified with a lysosomotropic ligand, octadecyl rhodamine B can deliver cargo to lysosomes. Ceramides are useful in inducing lysosomal membrane permeabilization; the invention comprehends intracellular delivery of a lipid entity of the invention having a ceramide. The invention further comprehends a lipid entity of the invention targeting the nucleus, e.g., via a DNA-intercalating moiety. The invention also comprehends multifunctional liposomes for targeting, i.e., attaching more than one functional group to the surface of the lipid entity of the invention, for instance to enhances accumulation in a desired site and/or promotes organelle-specific delivery and/or target a particular type of cell and/or respond to the local stimuli such as temperature (e.g., elevated), pH (e.g., decreased), respond to externally applied stimuli such as a magnetic field, light, energy, heat or ultrasound and/or promote intracellular delivery of the cargo. All of these are considered actively targeting moieties.

An embodiment of the invention includes the delivery system comprising an actively targeting lipid particle or nanoparticle or liposome or lipid bylayer delivery system; or comprising a lipid particle or nanoparticle or liposome or lipid bylayer comprising a targeting moiety whereby there is active targeting or wherein the targeting moiety is an actively targeting moiety. A targeting moiety can be one or more targeting moieties, and a targeting moiety can be for any desired type of targeting such as, e.g., to target a cell such as any herein-mentioned; or to target an organelle such as any herein-mentioned; or for targeting a response such as to a physical condition such as heat, energy, ultrasound, light, pH, chemical such as enzymatic, or magnetic stimuli; or to target to achieve a particular outcome such as delivery of payload to a particular location, such as by cell penetration.

Targeting Moiety

It should be understood that as to each possible targeting or active targeting moiety herein-discussed, there is an aspect of the invention wherein the delivery system comprises such a targeting or active targeting moiety. Likewise, the following table provides exemplary targeting moieties that can be used in the practice of the invention an as to each an aspect of the invention provides a delivery system that comprises such a targeting moiety.

TABLE 17

| Targeting Moiety | Target Molecule | Target Cell or Tissue |
| --- | --- | --- |
| folate | folate receptor | cancer cells |
| transferrin | transferrin receptor | cancer cells |
| Antibody CC52 | rat CC531 | rat colon adenocarcinoma CC531 |
| anti- HER2 antibody | HER2 | HER2-overexpressing tumors |
| anti-GD2 | GD2 | neuroblastoma, melanoma |
| anti-EGFR | EGFR | tumor cells overexpressingEGFR |
| pH-dependent fusogenic peptide diINF-7 | | ovarian carcinoma |
| anti-VEGFR | VEGF Receptor | tumor vasculature |
| anti-CD19 | CD19 (B cell marker) | leukemia, lymphoma |
| cell-penetrating peptide cyclic arginine-glycine-aspartic acid-tyrosine-cysteine peptide (c(RGDyC)-LP) | $\alpha v \beta 3$ | blood-brain barrier glioblastoma cells, human umbilical vein endothelial cells, tumor angiogenesis |
| ASSHN peptide (SEQ ID NO: 262) | | endothelial progenitor cells; anti- cancer |
| PR_b peptide | $\alpha_5\beta_1$ integrin | cancer cells |
| AG86 peptide | $\alpha_6\beta_4$ integrin | cancer cells |
| KCCYSL (SEQ ID NO: 263) (P6.1 peptide) | HER-2 receptor | cancer cells |
| affinity peptide LN (YEVGHRC (SEQ ID NO: 264)) | Aminopeptidase N (APN/CD13) | APN-positive tumor |
| synthetic somatostatin analogue | Somatostatin receptor 2 (SSTR2) | breast cancer |
| anti-CD20 monoclonal antibody | B-lymphocytes | B cell lymphoma |

Thus, in an embodiment of the delivery system, the targeting moiety comprises a receptor ligand, such as, for example, hyaluronic acid for CD44 receptor, galactose for hepatocytes, or antibody or fragment thereof such as a binding antibody fragment against a desired surface receptor, and as to each of a targeting moiety comprising a receptor ligand, or an antibody or fragment thereof such as a binding fragment thereof, such as against a desired surface receptor, there is an aspect of the invention wherein the delivery system comprises a targeting moiety comprising a receptor ligand, or an antibody or fragment thereof such as a binding fragment thereof, such as against a desired surface receptor, or hyaluronic acid for CD44 receptor, galactose for hepatocytes (see, e.g., Surace et al, "Lipoplexes targeting the CD44 hyaluronic acid receptor for efficient transfection of breast cancer cells," J. Mol Pharm 6(4):1062-73; doi: 10.1021/mp800215d (2009); Sonoke et al, "Galactose-modified cationic liposomes as a liver-targeting delivery system for small interfering RNA," Biol Pharm Bull. 34(8): 1338-42 (2011); Torchilin, "Antibody-modified liposomes for cancer chemotherapy," Expert Opin. Drug Deliv. 5 (9), 1003-1025 (2008); Manjappa et al, "Antibody derivatization and conjugation strategies: application in preparation of stealth immunoliposome to target chemotherapeutics to tumor," J. Control. Release 150 (1), 2-22 (2011); Sofou S "Antibody-targeted liposomes in cancer therapy and imaging," Expert Opin. Drug Deliv. 5 (2): 189-204 (2008); Gao J et al, "Antibody-targeted immunoliposomes for cancer treatment," Mini. Rev. Med. Chem. 13(14): 2026-2035 (2013); Molavi et al, "Anti-CD30 antibody conjugated liposomal doxorubicin with significantly improved therapeutic efficacy against anaplastic large cell lymphoma," Biomaterials 34(34):8718-25 (2013), each of which and the documents cited therein are hereby incorporated herein by reference).

Moreover, in view of the teachings herein the skilled artisan can readily select and apply a desired targeting moiety in the practice of the invention as to a lipid entity of the invention. The invention comprehends an embodiment wherein the delivery system comprises a lipid entity having a targeting moiety.

Additional Delivery Approaches

In an embodiment of the delivery system, the protein comprises a CRISPR protein, or portion thereof.

In some embodiments a non-capsid protein or protein that is not a virus outer protein or a virus envelope (sometimes herein shorthanded as "non-capsid protein"), such as a CRISPR protein or portion thereof, can have one or more functional moiety(ies) thereon, such as a moiety for targeting or locating, such as an NLS or NES, or an activator or repressor.

In an embodiment of the delivery system, a protein or portion thereof can comprise a tag.

In an aspect, the invention provides a virus particle comprising a capsid or outer protein having one or more hybrid virus capsid or outer proteins comprising the virus capsid or outer protein attached to at least a portion of a non-capsid protein or a CRISPR protein.

In an aspect, the invention provides an in vitro method of delivery comprising contacting the delivery system with a cell, optionally a eukaryotic cell, whereby there is delivery into the cell of constituents of the delivery system.

In an aspect, the invention provides an in vitro, a research or study method of delivery comprising contacting the delivery system with a cell, optionally a eukaryotic cell, whereby there is delivery into the cell of constituents of the delivery system, obtaining data or results from the contacting, and transmitting the data or results.

In an aspect, the invention provides a cell from or of an in vitro method of delivery, wherein the method comprises contacting the delivery system with a cell, optionally a eukaryotic cell, whereby there is delivery into the cell of constituents of the delivery system, and optionally obtaining data or results from the contacting, and transmitting the data or results.

In an aspect, the invention provides a cell from or of an in vitro method of delivery, wherein the method comprises contacting the delivery system with a cell, optionally a eukaryotic cell, whereby there is delivery into the cell of constituents of the delivery system, and optionally obtaining data or results from the contacting, and transmitting the data or results; and wherein the cell product is altered compared to the cell not contacted with the delivery system, for example altered from that which would have been wild type of the cell but for the contacting.

In an embodiment, the cell product is non-human or animal.

In one aspect, the invention provides a particle delivery system comprising a composite virus particle, wherein the composite virus particle comprises a lipid, a virus capsid protein, and at least a portion of a non-capsid protein or peptide. The non-capsid peptide or protein can have a molecular weight of up to one megadalton.

In one embodiment, the particle delivery system comprises a virus particle adsorbed to a liposome or lipid particle or nanoparticle. In one embodiment, a virus is adsorbed to a liposome or lipid particle or nanoparticle either through electrostatic interactions, or is covalently linked through a linker. The lipid particle or nanoparticles (1 mg/ml) dissolved in either sodium acetate buffer (pH 5.2) or pure H2O (pH 7) are positively charged. The isoelectropoint of most viruses is in the range of 3.5-7. They have a negatively charged surface in either sodium acetate buffer (pH 5.2) or pure H2O. The electrostatic interaction between the virus and the liposome or synthetic lipid nanoparticle is the most significant factor driving adsorption. By modifying the charge density of the lipid nanoparticle, e.g. inclusion of neutral lipids into the lipid nanoparticle, it is possible to modulate the interaction between the lipid nanoparticle and the virus, hence modulating the assembly. In one embodiment, the liposome comprises a cationic lipid.

In one embodiment, the liposome of the particle delivery system comprises a CRISPR system component.

In one aspect, the invention provides a delivery system comprising one or more hybrid virus capsid proteins in combination with a lipid particle, wherein the hybrid virus capsid protein comprises at least a portion of a virus capsid protein attached to at least a portion of a non-capsid protein.

In one embodiment, the virus capsid protein of the delivery system is attached to a surface of the lipid particle. When the lipid particle is a bilayer, e.g., a liposome, the lipid particle comprises an exterior hydrophilic surface and an interior hydrophilic surface. In one embodiment, the virus capsid protein is attached to a surface of the lipid particle by an electrostatic interaction or by hydrophobic interaction.

In one embodiment, the particle delivery system has a diameter of 50-1000 nm, preferably 100-1000 nm.

In one embodiment, the delivery system comprises a non-capsid protein or peptide, wherein the non-capsid protein or peptide has a molecular weight of up to a megadalton. In one embodiment, the non-capsid protein or peptide has a molecular weight in the range of 110 to 160 kDa, 160 to 200 kDa, 200 to 250 kDa, 250 to 300 kDa, 300 to 400 kDa, or 400 to 500 kDa.

In one embodiment, the delivery system comprises a non-capsid protein or peptide, wherein the protein or peptide comprises a CRISPR protein or peptide. In one embodiment, the protein or peptide comprises a Cas9, a Cpf1 or a C2c2/Cas13a.

In one embodiment, a weight ratio of hybrid capsid protein to wild-type capsid protein is from 1:10 to 1:1, for example, 1:1, 1:2, 1:3, 1:4, 1:5, 1:6, 1:7, 1:8, 1:9 and 1:10.

In one embodiment, the virus of the delivery system is an Adenoviridae or a Parvoviridae or a Rhabdoviridae or an enveloped virus having a glycoprotein protein. In one embodiment, the virus is an adeno-associated virus (AAV) or an adenovirus or a VSV or a rabies virus. In one embodiment, the virus is a retrovirus or a lentivirus. In one embodiment, the virus is murine leukemia virus (MuMLV).

In one embodiment, the virus capsid protein of the delivery system comprises VP1, VP2 or VP3.

In one embodiment, the virus capsid protein of the delivery system is VP3, and the non-capsid protein is inserted into or tethered or connected to VP3 loop 3 or loop 6.

In one embodiment, the virus of the delivery system is delivered to the interior of a cell.

In one embodiment, the virus capsid protein and the non-capsid protein are capable of dissociating after delivery into a cell.

In one aspect of the delivery system, the virus capsid protein is attached to the non-capsid protein by a linker. In one embodiment, the linker comprises amino acids. In one embodiment, the linker is a chemical linker. In another embodiment, the linker is cleavable or biodegradable. In one embodiment, the linker comprises (GGGGS)1-3 SEQ ID NO: 210-211, 198), ENLYFQG (SEQ ID NO:255), or a disulfide.

In one embodiment of the delivery system, each terminus of the non-capsid protein is attached to the capsid protein by a linker moiety.

In one embodiment, the non-capsid protein is attached to the exterior portion of the virus capsid protein. As used herein, "exterior portion" as it refers to a virus capsid protein means the outer surface of the virus capsid protein when it is in a formed virus capsid.

In one embodiment, the non-capsid protein is attached to the interior portion of the capsid protein or is encapsulated within the lipid particle. As used herein, "interior portion" as it refers to a virus capsid protein means the inner surface of the virus capsid protein when it is in a formed virus capsid. In one embodiment, the virus capsid protein and the non-capsid protein are a fusion protein.

In one embodiment, the fusion protein is attached to the surface of the lipid particle.

In one embodiment, the non-capsid protein is attached to the virus capsid protein prior to formation of the capsid.

In one embodiment, the non-capsid protein is attached to the virus capsid protein after formation of the capsid.

In one embodiment, the non-capsid protein comprises a targeting moiety.

In one embodiment, the targeting moiety comprises a receptor ligand.

In an embodiment, the non-capsid protein comprises a tag.

In an embodiment, the non-capsid protein comprises one or more heterologous nuclear localization signals(s) (NLSs).

In an embodiment, the protein or peptide comprises a Type II CRISPR protein or a Type V CRISPR protein.

In an embodiment, the delivery system further comprises guide RNS, optionally complexed with the CRISPR protein.

In an embodiment, the delivery system comprises a protease or nucleic acid molecule(s) encoding a protease that is expressed, whereby the protease cleaves the linker. In certain embodiments, there is protease expression, linker cleavage, and dissociation of payload from capsid in the absence of productive virus replication.

In an aspect, the invention provides a delivery system comprising a first hybrid virus capsid protein and a second hybrid virus capsid protein, wherein the first hybrid virus capsid protein comprises a virus capsid protein attached to a first part of a protein, and wherein the second hybrid virus capsid protein comprises a second virus capsid protein attached to a second part of the protein, wherein the first part of the protein and the second part of the protein are capable of associating to form a functional protein.

In an aspect, the invention provides a delivery system comprising a first hybrid virus capsid protein and a second hybrid virus capsid protein, wherein the first hybrid virus capsid protein comprises a virus capsid protein attached to a first part of a CRISPR protein, and wherein the second hybrid virus capsid protein comprises a second virus capsid protein attached to a second part of a CRISPR protein, wherein the first part of the CRISPR protein and the second part of the CRISPR protein are capable of associating to form a functional CRISPR protein.

In an embodiment of the delivery system, the first hybrid virus capsid protein and the second virus capsid protein are on the surface of the same virus particle.

In an embodiment of the delivery system, the first hybrid virus capsule protein is located at the interior of a first virus particle and the second hybrid virus capsid protein is located at the interior of a second virus particle.

In an embodiment of the delivery system, the first part of the protein or CRISPR protein is linked to a first member of a ligand pair, and the second part of the protein or CRISPR protein is linked to a second member of a ligand pair, wherein the first part of the ligand pair binds to the second part of the ligand pair in a cell. In an embodiment, the binding of the first part of the ligand pair to the second part of the ligand pair is inducible.

In an embodiment of the delivery system, either or both of the first part of the protein or CRISPR protein and the second part of the protein or CRISPR protein comprise one or more NLSs.

In an embodiment of the delivery system, either or both of the first part of the protein or CRISPR protein and the second part of the protein or CRISPR protein comprise one or more nuclear export signals (NESs).

In certain embodiments, the virus structural component comprises one or more capsid proteins including an entire capsid. In certain embodiments, such as wherein a viral capsid comprises multiple copies of different proteins, the delivery system can provide one or more of the same protein or a mixture of such proteins. For example, AAV comprises 3 capsid proteins, VP1, VP2, and VP3, thus delivery systems of the invention can comprise one or more of VP1, and/or one or more of VP2, and/or one or more of VP3. Accordingly, the present invention is applicable to a virus within the family Adenoviridae, such as Atadenovirus, e.g., Ovine atadenovirus D, Aviadenovirus, e.g., Fowl aviadenovirus A, Ichtadenovirus, e.g., Sturgeon ichtadenovirus A, Mastadenovirus (which includes adenoviruses such as all human adenoviruses), e.g., Human mastadenovirus C, and Siadenovirus, e.g., Frog siadenovirus A. Thus, a virus of within the family Adenoviridae is contemplated as within the invention with discussion herein as to adenovirus applicable to other family members. Target-specific AAV capsid variants can be used or selected. Non-limiting examples include capsid variants selected to bind to chronic myelogenous leukemia cells, human CD34 PBPC cells, breast cancer cells, cells of lung, heart, dermal fibroblasts, melanoma cells, stem cell, glioblastoma cells, coronary artery endothelial cells and keratinocytes. See, e.g., Buning et al, 2015, Current Opinion in Pharmacology 24, 94-104. From teachings herein and knowledge in the art as to modifications of adenovirus (see, e.g., U.S. Pat. Nos. 9,410,129, 7,344,872, 7,256,036, 6,911,199, 6,740,525; Matthews, "Capsid-Incorporation of Antigens into Adenovirus Capsid Proteins for a Vaccine Approach," Mol Pharm, 8(1): 3-11 (2011)), as well as regarding modifications of AAV, the skilled person can readily obtain a modified adenovirus that has a large payload protein or a CRISPR-protein, despite that heretofore it was not expected that such a large protein could be provided on an adenovirus. And as to the viruses related to adenovirus mentioned herein, as well as to the viruses related to AAV mentioned herein, the teachings herein as to modifying adenovirus and AAV, respectively, can be applied to those viruses without undue experimentation from this disclosure and the knowledge in the art.

In another aspect, the invention provides a non-naturally occurring or engineered CRISPR protein associated with Adeno Associated Virus (AAV), e.g., an AAV comprising a CRISPR protein as a fusion, with or without a linker, to or with an AAV capsid protein such as VP1, VP2, and/or VP3; and, for shorthand purposes, such a non-naturally occurring or engineered CRISPR protein is herein termed a "AAV-CRISPR protein" More in particular, modifying the knowledge in the art, e.g., Rybniker et al., "Incorporation of Antigens into Viral Capsids Augments Immunogenicity of Adeno-Associated Virus Vector-Based Vaccines," J Virol. December 2012; 86(24): 13800-13804, Lux K, et al. 2005. Green fluorescent protein-tagged adeno-associated virus particles allow the study of cytosolic and nuclear trafficking. J. Virol. 79:11776-11787, Munch RC, et al. 2012. "Displaying high-affinity ligands on adeno-associated viral vectors enables tumor cell-specific and safe gene transfer." Mol. Ther. [Epub ahead of print.] doi:10.1038/mt.2012.186 and Warrington KH, Jr, et al. 2004. Adeno-associated virus type 2 VP2 capsid protein is nonessential and can tolerate large peptide insertions at its N terminus. J. Virol. 78:6595-6609, each incorporated herein by reference, one can obtain a modified AAV capsid of the invention. It will be understood by those skilled in the art that the modifications described herein if inserted into the AAV cap gene may result in modifications in the VP1, VP2 and/or VP3 capsid subunits. Alternatively, the capsid subunits can be expressed independently to achieve modification in only one or two of the capsid subunits (VP1, VP2, VP3, VP1+VP2, VP1+VP3, or VP2+VP3). One can modify the cap gene to have expressed at a desired location a non-capsid protein advantageously a large payload protein, such as a CRISPR-protein. Likewise, these can be fusions, with the protein, e.g., large payload protein such as a CRISPR-protein fused in a manner analogous to prior art fusions. See, e.g., US Patent Publication 20090215879; Nance et al., "Perspective on Adeno-Associated Virus Capsid Modification for Duchenne Muscular Dystrophy Gene Therapy," Hum Gene Ther. 26(12):786-800 (2015) and documents cited therein, incorporated herein by reference. The skilled person, from this disclosure and the knowledge in the art can make and use modified AAV or AAV capsid as in the herein invention, and through this disclosure one knows now that large payload proteins can be fused to the AAV capsid. Applicants provide AAV capsid-CRISPR protein (e.g., Cas, Cas9, dCas9, Cpf1, Cas13a, Cas13b) fusions and those AAV-capsid CRISPR protein (e.g., Cas, Cas9) fusions can be a recombinant AAV that contains nucleic acid molecule(s) encoding or providing CRISPR-Cas or CRISPR system or complex RNA guide(s), whereby the CRISPR protein (e.g., Cas, Cas9) fusion delivers a CRISPR-Cas or CRISPR system complex (e.g., the CRISPR protein or Cas or Cas9 or Cpf1 is provided by the fusion, e.g., VP1, VP2, pr VP3 fusion, and the guide RNA is provided by the coding of the recombinant virus, whereby in vivo, in a cell, the CRISPR-Cas or CRISPR system is assembled from the nucleic acid molecule(s) of the recombinant providing the guide RNA and the outer surface of the virus providing the CRISPR-Enzyme or Cas or Cas9. Such as complex may herein be termed an "AAV-CRISPR system" or an "AAV—CRISPR-Cas" or "AAV-CRISPR complex" or AAV—CRISPR-Cas complex." Accordingly, the instant invention is also applicable to a virus in the genus Dependoparvovirus or in the family Parvoviridae, for instance, AAV, or a virus of Amdoparvovirus, e.g., Carnivore amdoparvovirus 1, a virus of Aveparvovirus, e.g., Galliform aveparvovirus 1, a virus of Bocaparvovirus, e.g., Ungulate bocaparvovirus 1, a virus of Copiparvovirus, e.g., Ungulate copiparvovirus 1, a virus of Dependoparvovirus, e.g., Adeno-associated dependoparvovirus A, a virus of Erythroparvovirus, e.g., Primate erythroparvovirus 1, a virus of Protoparvovirus, e.g., Rodent protoparvovirus 1, a virus of Tetraparvovirus, e.g., Primate tetraparvovirus 1. Thus, a virus of within the family Parvoviridae or the genus Dependoparvovirus or any of the other foregoing genera within Parvoviridae is contemplated as within the invention with discussion herein as to AAV applicable to such other viruses.

In one aspect, the invention provides a non-naturally occurring or engineered composition comprising a CRISPR enzyme which is part of or tethered to a AAV capsid domain, i.e., VP1, VP2, or VP3 domain of Adeno-Associated Virus (AAV) capsid. In some embodiments, part of or tethered to a AAV capsid domain includes associated with associated with a AAV capsid domain. In some embodiments, the CRISPR enzyme may be fused to the AAV capsid domain. In some embodiments, the fusion may be to the N-terminal end of the AAV capsid domain. As such, in some embodiments, the C-terminal end of the CRISPR enzyme is fused to the N-terminal end of the AAV capsid domain. In some embodiments, an NLS and/or a linker (such as a GlySer linker) may be positioned between the C-terminal end of the CRISPR enzyme and the N-terminal end of the AAV capsid domain. In some embodiments, the fusion may be to the C-terminal end of the AAV capsid domain. In some embodiments, this is not preferred due to the fact that the VP1, VP2 and VP3 domains of AAV are alternative splices of the same RNA and so a C-terminal fusion may affect all three domains. In some embodiments, the AAV capsid domain is truncated. In some embodiments, some or all of the AAV capsid domain is removed. In some embodiments, some of the AAV capsid domain is removed and replaced with a linker (such as a GlySer linker), typically leaving the N-terminal and C-terminal ends of the AAV capsid domain intact, such as the first 2, 5 or 10 amino acids. In this way, the internal (non-terminal) portion of the VP3 domain may be replaced with a linker. It is particularly preferred that the linker is fused to the CRISPR protein. A branched linker may be used, with the CRISPR protein fused to the end of one of the braches. This allows for some degree of spatial separation between the capsid and the CRISPR protein. In this way, the CRISPR protein is part of (or fused to) the AAV capsid domain.

Alternatively, the CRISPR enzyme may be fused in frame within, i.e. internal to, the AAV capsid domain. Thus in some embodiments, the AAV capsid domain again preferably retains its N-terminal and C-terminal ends. In this case, a linker is preferred, in some embodiments, either at one or both ends of the CRISPR enzyme. In this way, the CRISPR enzyme is again part of (or fused to) the AAV capsid domain. In certain embodiments, the positioning of the CRISPR enzyme is such that the CRISPR enzyme is at the external surface of the viral capsid once formed. In one aspect, the invention provides a non-naturally occurring or engineered composition comprising a CRISPR enzyme associated with a AAV capsid domain of Adeno-Associated Virus (AAV) capsid. Here, associated may mean in some embodiments fused, or in some embodiments bound to, or in some embodiments tethered to. The CRISPR protein may, in some embodiments, be tethered to the VP1, VP2, or VP3 domain. This may be via a connector protein or tethering system such as the biotin-streptavidin system. In one example, a biotinylation sequence (15 amino acids) could therefore be fused to the CRISPR protein. When a fusion of the AAV capsid domain, especially the N-terminus of the AAV AAV capsid domain, with streptavidin is also provided, the two will therefore associate with very high affinity. Thus, in some embodiments, provided is a composition or system comprising a CRISPR protein-biotin fusion and a streptavidin-AAV capsid domain arrangement, such as a fusion. The CRISPR protein-biotin and streptavidin-AAV capsid domain forms a single complex when the two parts are brought together. NLSs may also be incorporated between the CRISPR protein and the biotin; and/or between the streptavidin and the AAV capsid domain.

An alternative tether may be to fuse or otherwise associate the AAV capsid domain to an adaptor protein which binds to or recognizes to a corresponding RNA sequence or motif. In some embodiments, the adaptor is or comprises a binding protein which recognizes and binds (or is bound by) an RNA sequence specific for said binding protein. In some embodiments, a preferred example is the MS2 (see Konermann et al. December 2014, cited infra, incorporated herein by reference) binding protein which recognizes and binds (or is bound by) an RNA sequence specific for the MS2 protein.

With the AAV capsid domain associated with the adaptor protein, the CRISPR protein may, in some embodiments, be tethered to the adaptor protein of the AAV capsid domain. The CRISPR protein may, in some embodiments, be tethered to the adaptor protein of the AAV capsid domain via the CRISPR enzyme being in a complex with a modified guide, see Konermann et al. The modified guide is, in some embodiments, a sgRNA. In some embodiments, the modified guide comprises a distinct RNA sequence; see, e.g., PCT/US14/70175, incorporated herein by reference.

In some embodiments, distinct RNA sequence is an aptamer. Thus, corresponding aptamer-adaptor protein systems are preferred. One or more functional domains may also be associated with the adaptor protein. An example of a preferred arrangement would be:

[AAV AAV Capsid Domain—Adaptor Protein]—[Modified Guide—CRISPR Protein]

In certain embodiments, the positioning of the CRISPR protein is such that the CRISPR protein is at the internal surface of the viral capsid once formed. In one aspect, the invention provides a non-naturally occurring or engineered composition comprising a CRISPR protein associated with an internal surface of an AAV capsid domain. Here again, associated may mean in some embodiments fused, or in some embodiments bound to, or in some embodiments tethered to. The CRISPR protein may, in some embodiments, be tethered to the VP1, VP2, or VP3 domain such that it locates to the internal surface of the viral capsid once formed. This may be via a connector protein or tethering system such as the biotin-streptavidin system as described above.

When the CRISPR protein fusion is designed so as to position the CRISPR protein at the internal surface of the capsid once formed, the CRISPR protein will fill most or all of internal volume of the capsid. Alternatively the CRISPR protein may be modified or divided so as to occupy a less of the capsid internal volume. Accordingly, in certain embodiments, the invention provides a CRISRP protein divided in two portions, one portion comprises in one viral particle or capsid and the second portion comprised in a second viral particle or capsid. In certain embodiments, by splitting the CRISPR protein in two portions, space is made available to link one or more heterologous domains to one or both CRISPR protein portions.

Split CRISPR proteins are set forth herein and in documents incorporated herein by reference in further detail herein. In certain embodiments, each part of a split CRISRP proteins are attached to a member of a specific binding pair, and when bound with each other, the members of the specific binding pair maintain the parts of the CRISPR protein in proximity. In certain embodiments, each part of a split CRISPR protein is associated with an inducible binding pair. An inducible binding pair is one which is capable of being switched "on" or "off" by a protein or small molecule that binds to both members of the inducible binding pair. In general, according to the invention, CRISPR proteins may preferably split between domains, leaving domains intact. Preferred, non-limiting examples of such CRISPR proteins include, without limitation, Cas9, Cpf1, C2c2, Cas13a, Cas13b, and orthologues. Preferred, non-limiting examples of split points include, with reference to SpCas9: a split position between 202A/203S; a split position between 255F/256D; a split position between 310E/311I; a split position between 534R/535K; a split position between 572E/573C; a split position between 7135/714G; a split position between 1003L/104E; a split position between 1054G/1055E; a split position between 1114N/1115S; a split position between 1152K/1153S; a split position between 1245K/1246G; or a split between 1098 and 1099.

In some embodiments, any AAV serotype is preferred. In some embodiments, the VP2 domain associated with the CRISPR enzyme is an AAV serotype 2 VP2 domain. In some embodiments, the VP2 domain associated with the CRISPR enzyme is an AAV serotype 8 VP2 domain. The serotype can be a mixed serotype as is known in the art.

The CRISPR enzyme may form part of a CRISPR-Cas system, which further comprises a guide RNA (sgRNA) comprising a guide sequence capable of hybridizing to a target sequence in a genomic locus of interest in a cell. In some embodiments, the functional CRISPR-Cas system binds to the target sequence. In some embodiments, the functional CRISPR-Cas system may edit the genomic locus to alter gene expression. In some embodiments, the functional CRISPR-Cas system may comprise further functional domains.

In some embodiments, the CRISPR enzyme is a Cpf1. In some embodiments, the CRISPR enzyme is an FnCpf1. In some embodiments, the CRISPR enzyme is an AsCpf1, although other orthologs are envisaged. FnCpf1 and AsCpf1 are particularly preferred, in some embodiments.

In some embodiments, the CRISPR enzyme is external to the capsid or virus particle. In the sense that it is not inside the capsid (enveloped or encompassed with the capsid), but is externally exposed so that it can contact the target genomic DNA). In some embodiments, the CRISPR enzyme cleaves both strands of DNA to produce a double strand break (DSB). In some embodiments, the CRISPR enzyme is a nickase. In some embodiments, the CRISPR enzyme is a dual nickase. In some embodiments, the CRISPR enzyme is a dead Cas. In some general embodiments, the CRISPR enzyme is associated with one or more functional domains. In some more specific embodiments, the CRISPR enzyme is a dead Cas and is associated with one or more functional domains. In some embodiments, the CRISPR enzyme comprises a Rec2 or HD2 truncation. In some embodiments, the CRISPR enzyme is associated with the AAV VP2 domain by way of a fusion protein. In some embodiments, the CRISPR enzyme is fused to Destabilization Domain (DD). In other words, the DD may be associated with the CRISPR enzyme by fusion with said CRISPR enzyme. The AAV can then, by way of nucleic acid molecule(s) deliver the stabilizing ligand (or such can be otherwise delivered) In some embodiments, the enzyme may be considered to be a modified CRISPR enzyme, wherein the CRISPR enzyme is fused to at least one destabilization domain (DD) and VP2. In some embodiments, the association may be considered to be a modification of the VP2 domain. Where reference is made herein to a modified VP2 domain, then this will be understood to include any association discussed herein of the VP2 domain and the CRISPR enzyme. In some embodiments, the AAV VP2 domain may be associated (or tethered) to the CRISPR enzyme via a connector protein, for example using a system such as the streptavidin-biotin system. As such, provided is a fusion of a CRISPR enzyme with a connector protein specific for a high affinity ligand for that connector, whereas the AAV VP2 domain is bound to said high affinity ligand. For example, streptavidin may be the connector fused to the CRISPR enzyme, while biotin may be bound to the AAV VP2 domain. Upon co-localization, the streptavidin will bind to the biotin, thus connecting the CRISPR enzyme to the AAV VP2 domain. The reverse arrangement is also possible. In some embodiments, a biotinylation sequence (15 amino acids) could therefore be fused to the AAV VP2 domain, especially the N-terminus of the AAV VP2 domain. A fusion of the CRISPR enzyme with streptavidin is also preferred, in some embodiments. In some embodiments, the biotinylated AAV capsids with streptavidin-CRISPR enzyme are assembled in vitro. This way the AAV capsids should assemble in a straightforward manner and the CRISPR enzyme-streptavidin fusion can be added after assembly of the capsid. In other embodiments a biotinylation sequence (15 amino acids) could therefore be fused to the CRISPR enzyme, together with a fusion of the AAV VP2 domain, especially the N-terminus of the AAV VP2 domain, with streptavidin. For simplicity, a fusion of the CRISPR enzyme and the AAV VP2 domain is preferred in some embodiments. In some embodiments, the fusion may be to the N-terminal end of the CRISPR enzyme. In other words, in some embodiments, the AAV and CRISPR enzyme are associated via fusion. In some embodiments, the AAV and CRISPR enzyme are associated via fusion including a linker. Suitable linkers are discussed herein, and include Gly Ser linkers. Fusion to the N-term of AAV VP2 domain is preferred, in some embodiments. In some embodiments, the CRISPR enzyme comprises at least one Nuclear Localization Signal (NLS). In an aspect, the present invention provides a polynucleotide encoding the present CRISPR enzyme and associated AAV VP2 domain.

Viral delivery vectors, for example modified viral delivery vectors, are hereby provided. While the AAV may advantageously be a vehicle for providing RNA of the CRISPR-Cas Complex or CRISPR system, another vector may also deliver that RNA, and such other vectors are also herein discussed. In one aspect, the invention provides a non-naturally occurring modified AAV having a VP2-CRISPR enzyme capsid protein, wherein the CRISPR enzyme is part of or tethered to the VP2 domain. In some preferred embodiments, the CRISPR enzyme is fused to the VP2 domain so that, in another aspect, the invention provides a non-naturally occurring modified AAV having a VP2-CRISPR enzyme fusion capsid protein. The following embodiments apply equally to either modified AAV aspect, unless otherwise apparent. Thus, reference herein to a VP2-CRISPR enzyme capsid protein may also include a VP2-CRISPR enzyme fusion capsid protein. In some embodiments, the VP2-CRISPR enzyme capsid protein further comprises a linker. In some embodiments, the VP2-CRISPR enzyme capsid protein further comprises a linker, whereby the VP2-CRISPR enzyme is distanced from the remainder of the AAV. In some embodiments, the VP2-CRISPR enzyme capsid protein further comprises at least one protein complex, e.g., CRISPR complex, such as CRISPR-Cas complex guide RNA that targets a particular DNA, TALE, etc. A CRISPR complex, such as CRISPR-Cas system comprising the VP2-CRISPR enzyme capsid protein and at least one CRISPR complex, such as CRISPR-Cas complex guide RNA that targets a particular DNA, is also provided in one aspect. In general, in some embodiments, the AAV further comprises a repair template. It will be appreciated that comprises here may mean encompassed thin the viral capsid or that the virus encodes the comprised protein. In some embodiments, one or more, preferably two or more guide RNAs, may be comprised/encompassed within the AAV vector. Two may be preferred, in some embodiments, as it allows for multiplexing or dual nickase approaches. Particularly for multiplexing, two or more guides may be used. In fact, in some embodiments, three or more, four or more, five or more, or even six or more guide RNAs may be comprised/encompassed within the AAV. More space has been freed up within the AAV by virtue of the fact that the AAV no longer needs to comprise/encompass the CRISPR enzyme. In each of these instances, a repair template may also be provided comprised/encompassed within the AAV. In some embodiments, the repair template corresponds to or includes the DNA target.

In a further aspect, the present invention provides compositions comprising the CRISPR enzyme and associated AAV VP2 domain or the polynucleotides or vectors described herein. Also provides are CRISPR-Cas systems comprising guide RNAs.

Also provided is a method of treating a subject in need thereof, comprising inducing gene editing by transforming the subject with the polynucleotide encoding the system or any of the present vectors. A suitable repair template may also be provided, for example delivered by a vector comprising said repair template. In some embodiments, a single vector provides the CRISPR enzyme through (association with the viral capsid) and at least one of: guide RNA; and/or a repair template. Also provided is a method of treating a subject in need thereof, comprising inducing transcriptional activation or repression by transforming the subject with the polynucleotide encoding the present system or any of the present vectors, wherein said polynucleotide or vector encodes or comprises the catalytically inactive CRISPR enzyme and one or more associated functional domains. Compositions comprising the present system for use in said method of treatment are also provided. A kit of parts may be provided including such compositions. Use of the present system in the manufacture of a medicament for such methods of treatment are also provided.

Also provided is a pharmaceutical composition comprising the CRISPR enzyme which is part of or tethered to a VP2 domain of Adeno-Associated Virus (AAV) capsid; or the non-naturally occurring modified AAV; or a polynucleotide encoding them.

Also provided is a complex of the CRISPR enzyme with a guide RNA, such as sgRNA. The complex may further include the target DNA.

A split CRISPR enzyme, e.g., Cpf1, approach may be used. The so-called 'split Cas' approach Split Cas allows for the following. The Cas is split into two pieces and each of these are fused to one half of a dimer. Upon dimerization, the two parts of the Cas are brought together and the reconstituted Cas has been shown to be functional. Thus, one part of the split Cas may be associated with one VP2 domain and second part of the split Cas may be associated with another VP2 domain. The two VP2 domains may be in the same or different capsid. In other words, the split parts of the Cas could be on the same virus particle or on different virus particles.

In some embodiments, one or more functional domains may be associated with or tethered to CRISPR enzyme and/or may be associated with or tethered to modified guides via adaptor proteins. These can be used irrespective of the fact that the CRISPR enzyme may also be tethered to a virus outer protein or capsid or envelope, such as a VP2 domain or a capsid, via modified guides with aptamer RAN sequences that recognize correspond adaptor proteins.

In some embodiments, one or more functional domains comprise a transcriptional activator, repressor, a recombinase, a transposase, a histone remodeler, a demethylase, a DNA methyltransferase, a cryptochrome, a light inducible/controllable domain, a chemically inducible/controllable domain, an epigenetic modifying domain, or a combination thereof. Advantageously, the functional domain comprises an activator, repressor or nuclease.

In some embodiments, a functional domain can have methylase activity, demethylase activity, transcription activation activity, transcription repression activity, transcription release factor activity, histone modification activity, RNA cleavage activity or nucleic acid binding activity, or activity that a domain identified herein has.

Examples of activators include P65, a tetramer of the herpes simplex activation domain VP16, termed VP64, optimized use of VP64 for activation through modification of both the sgRNA design and addition of additional helper molecules, MS2, P65 and HSFlin the system called the synergistic activation mediator (SAM) (Konermann et al, "Genome-scale transcriptional activation by an engineered CRISPR-Cas9 complex," Nature 517(7536):583-8 (2015)); and examples of repressors include the KRAB (Kruppel-associated box) domain of Kox1 or SID domain (e.g. SID4X); and an example of a nuclease or nuclease domain suitable for a functional domain comprises Fok1.

Suitable functional domains for use in practice of the invention, such as activators, repressors or nucleases are also discussed in documents incorporated herein by reference, including the patents and patent publications herein-cited and incorporated herein by reference regarding general information on CRISPR-Cas Systems.

In some embodiments, the CRISPR enzyme comprises or consists essentially of or consists of a localization signal as, or as part of, the linker between the CRISPR enzyme and the AAV capsid, e.g., VP2. HA or Flag tags are also within the ambit of the invention as linkers as well as Glycine Serine linkers as short as GS up to (GGGGS)3 (SEQ ID NO: 198) In this regard it is mentioned that tags that can be used in embodiments of the invention include affinity tags, such as chitin binding protein (CBP), maltose binding protein (MBP), glutathione-S-transferase (GST), poly(His) tag; solubilization tags such as thioredoxin (TRX) and poly (NANP), MBP, and GST; chromatography tags such as those consisting of polyanionic amino acids, such as FLAG-tag; epitope tags such as V5-tag, Myc-tag, HA-tag and NE-tag; fluorescence tags, such as GFP and mCherry; protein tags that may allow specific enzymatic modification (such as biotinylation by biotin ligase) or chemical modification (such as reaction with FlAsH-EDT2 for fluorescence imaging).

Also provided is a method of treating a subject, e.g, a subject in need thereof, comprising inducing gene editing by transforming the subject with the AAV-CRISPR enzyme advantageously encoding and expressing in vivo the remaining portions of the CRISPR system (e.g., RNA, guides). A suitable repair template may also be provided, for example delivered by a vector comprising said repair template. Also provided is a method of treating a subject, e.g., a subject in need thereof, comprising inducing transcriptional activation or repression by transforming the subject with the AAV-CRISPR enzyme advantageously encoding and expressing in vivo the remaining portions of the CRISPR system (e.g., RNA, guides); advantageously in some embodiments the CRISPR enzyme is a catalytically inactive CRISPR enzyme and comprises one or more associated functional domains. Where any treatment is occurring ex vivo, for example in a cell culture, then it will be appreciated that the term 'subject' may be replaced by the phrase "cell or cell culture."

Compositions comprising the present system for use in said method of treatment are also provided. A kit of parts may be provided including such compositions. Use of the present system in the manufacture of a medicament for such methods of treatment are also provided. Use of the present system in screening is also provided by the present invention, e.g., gain of function screens. Cells which are artificially forced to overexpress a gene are able to down regulate the gene over time (re-establishing equilibrium) e.g. by negative feedback loops. By the time the screen starts the unregulated gene might be reduced again.

In one aspect, the invention provides an engineered, non-naturally occurring CRISPR-Cas system comprising a AAV-Cas protein and a guide RNA that targets a DNA molecule encoding a gene product in a cell, whereby the guide RNA targets the DNA molecule encoding the gene product and the Cas protein cleaves the DNA molecule encoding the gene product, whereby expression of the gene product is altered; and, wherein the Cas protein and the guide RNA do not naturally occur together. The invention comprehends the guide RNA comprising a guide sequence fused to a tracr sequence. In an embodiment of the invention the Cas protein is a type II CRISPR-Cas protein and in a preferred embodiment the Cas protein is a Cas protein. The invention further comprehends the coding for the Cas protein being codon optimized for expression in a eukaryotic cell. In a preferred embodiment the eukaryotic cell is a mammalian cell and in a more preferred embodiment the mammalian cell is a human cell. In a further embodiment of the invention, the expression of the gene product is decreased.

In another aspect, the invention provides an engineered, non-naturally occurring vector system comprising one or more vectors comprising a first regulatory element operably linked to a CRISPR-Cas system guide RNA that targets a DNA molecule encoding a gene product and a AAV-Cas protein. The components may be located on same or different vectors of the system, or may be the same vector whereby the AAV-Cas protein also delivers the RNA of the CRISPR system. The guide RNA targets the DNA molecule encoding the gene product in a cell and the AAV-Cas protein may cleaves the DNA molecule encoding the gene product (it may cleave one or both strands or have substantially no nuclease activity), whereby expression of the gene product is altered; and, wherein the AAV-Cas protein and the guide RNA do not naturally occur together. The invention comprehends the guide RNA comprising a guide sequence fused to a tracr sequence. In an embodiment of the invention the AAV-Cas protein is a type II AAV-CRISPR-Cas protein and in a preferred embodiment the AAV-Cas protein is an AAV-Cas protein. The invention further comprehends the coding for the AAV-Cas protein being codon optimized for expression in a eukaryotic cell. In a preferred embodiment the eukaryotic cell is a mammalian cell and in a more preferred embodiment the mammalian cell is a human cell. In a further embodiment of the invention, the expression of the gene product is decreased.

In another aspect, the invention provides a method of expressing an effector protein and guide RNA in a cell comprising introducing the vector according any of the vector delivery systems disclosed herein. In an embodiment of the vector for delivering an effector protein, the minimal promoter is the Mecp2 promoter, tRNA promoter, or U6. In a further embodiment, the minimal promoter is tissue specific.

The one or more polynucleotide molecules may be comprised within one or more vectors. The invention comprehends such polynucleotide molecule(s), for instance such polynucleotide molecules operably configured to express the protein and/or the nucleic acid component(s), as well as such vector(s).

In one aspect, the invention provides a vector system comprising one or more vectors. In some embodiments, the system comprises: (a) a first regulatory element operably linked to a tracr mate sequence and one or more insertion sites for inserting one or more guide sequences upstream of the tracr mate sequence, wherein when expressed, the guide sequence directs sequence-specific binding of a AAV-CRISPR complex to a target sequence in a eukaryotic cell, wherein the CRISPR complex comprises a AAV-CRISPR enzyme complexed with (1) the guide sequence that is hybridized to the target sequence, and (2) the tracr mate sequence that is hybridized to the tracr sequence; and (b) said AAV-CRISPR enzyme comprising at least one nuclear localization sequence and/or at least one NES; wherein components (a) and (b) are located on or in the same or different vectors of the system. In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of an AAV-CRISPR complex to a different target sequence in a eukaryotic cell. In some embodiments, the system comprises the tracr sequence under the control of a third regulatory element, such as a polymerase III promoter. In some embodiments, the tracr sequence exhibits at least 50%, 60%, 70%, 80%, 90%, 95%, or 99% of sequence complementarity along the length of the tracr mate sequence when optimally aligned. Determining optimal alignment is within the purview of one of skill in the art. For example, there are publicly and commercially available alignment algorithms and programs such as, but not limited to, ClustalW, Smith-Waterman in matlab, Bowtie, Geneious, Biopython and SeqMan. In some embodiments, the AAV-CRISPR complex comprises one or more nuclear localization sequences of sufficient strength to drive accumulation of said CRISPR complex in a detectable amount in the nucleus of a eukaryotic cell. Without wishing to be bound by theory, it is believed that a nuclear localization sequence is not necessary for AAV-CRISPR complex activity in eukaryotes, but that including such sequences enhances activity of the system, especially as to targeting nucleic acid molecules in the nucleus and/or having molecules exit the nucleus. In some embodiments, the AAV-CRISPR enzyme is a type II AAV-CRISPR system enzyme. In some embodiments, the AAV-CRISPR enzyme is a AAV-Cas enzyme. In some embodiments, the AAV-Cas enzyme is derived from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020,

*Candidatus* Methanoplasma *termitum, Eubacterium eligens, Moraxella bovoculi* 237, *Leptospira inadai*, Lachnospiraceae bacterium ND2006, *Porphyromonas crevioricanis* 3, *Prevotella disiens* and *Porphyromonas macacae* (e.g., a Cas of one of these organisms modified to have or be associated with at least one AAV), and may include further mutations or alterations or be a chimeric Cas. The enzyme may be a AAV-Cas homolog or ortholog. In some embodiments, the AAV-CRISPR enzyme is codon-optimized for expression in a eukaryotic cell. In some embodiments, the AAV-CRISPR enzyme directs cleavage of one or two strands at the location of the target sequence. In some embodiments, the AAV-CRISPR enzyme lacks DNA strand cleavage activity. In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length. In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Again, the RNA of the CRISPR System, while advantageously delivered via the AAV-CRISPR enzyme can also be delivered separately, e.g. via a separate vector.

In one aspect, the invention provides an AAV-CRISPR enzyme comprising one or more nuclear localization sequences and/or NES. In some embodiments, said AAV-CRISPR enzyme includes a regulatory element that drives transcription of component(s) of the CRISPR system (e.g., RNA, such as guide RNA and/or HR template nucleic acid molecule) in a eukaryotic cell such that said AAV-CRISPR enzyme delivers the CRISPR system accumulates in a detectable amount in the nucleus of the eukaryotic cell and/or is exported from the nucleus. In some embodiments, the regulatory element is a polymerase II promoter. In some embodiments, the AAV-CRISPR enzyme is a type II AAV-CRISPR system enzyme. In some embodiments, the AAV-CRISPR enzyme is a AAV-Cas enzyme. In some embodiments, the AAV-Cas enzyme is derived from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus* Methanoplasma *termitum, Eubacterium eligens, Moraxella bovoculi* 237, *Leptospira inadai*, Lachnospiraceae bacterium ND2006, *Porphyromonas crevioricanis* 3, *Prevotella disiens* and *Porphyromonas macacae* (e.g., Cas modified to have or be associated with at least one AAV), and may include further alteration or mutation of the Cas, and can be a chimeric Cas. In some embodiments, the AAV-CRISPR enzyme is codon-optimized for expression in a eukaryotic cell. In some embodiments, the AAV-CRISPR enzyme directs cleavage of one or two strands at the location of the target sequence. In some embodiments, the AAV-CRISPR enzyme lacks or substantially DNA strand cleavage activity (e.g., no more than 5% nuclease activity as compared with a wild type enzyme or enzyme not having the mutation or alteration that decreases nuclease activity).

In one aspect, the invention provides a AAV-CRISPR enzyme comprising one or more nuclear localization sequences of sufficient strength to drive accumulation of said AAV-CRISPR enzyme in a detectable amount in the nucleus of a eukaryotic cell. In some embodiments, the AAV-CRISPR enzyme is a type II AAV-CRISPR system enzyme. In some embodiments, the AAV-CRISPR enzyme is a AAV-Cas enzyme. In some embodiments, the AAV-Cas enzyme is derived from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus* Methanoplasma *termitum, Eubacterium eligens, Moraxella bovoculi* 237, *Leptospira inadai*, Lachnospiraceae bacterium ND2006, *Porphyromonas crevioricanis* 3, *Prevotella disiens* and *Porphyromonas macacae* (e.g., Cas modified to have or be associated with at least one AAV), and may include further alteration or mutation of the Cas, and can be a chimeric Cas. In some embodiments, the AAV-CRISPR enzyme is codon-optimized for expression in a eukaryotic cell. In some embodiments, the AAV-CRISPR enzyme directs cleavage of one or two strands at the location of the target sequence. In some embodiments, the AAV-CRISPR enzyme lacks or substantially DNA strand cleavage activity (e.g., no more than 5% nuclease activity as compared with a wild type enzyme or enzyme not having the mutation or alteration that decreases nuclease activity).

In one aspect, the invention provides a eukaryotic host cell comprising (a) a first regulatory element operably linked to a tracr mate sequence and one or more insertion sites for inserting one or more guide sequences upstream of the tracr mate sequence, wherein when expressed, the guide sequence directs sequence-specific binding of a AAV-CRISPR complex to a target sequence in a eukaryotic cell, wherein the AAV-CRISPR complex comprises a AAV-CRISPR enzyme complexed with (1) the guide sequence that is hybridized to the target sequence, and (2) the tracr mate sequence that is hybridized to the tracr sequence; and/or (b) a said AAV-CRISPR enzyme optionally comprising at least one nuclear localization sequence and/or NES. In some embodiments, the host cell comprises components (a) and (b). In some embodiments, component (a), component (b), or components (a) and (b) are stably integrated into a genome of the host eukaryotic cell. In some embodiments, component (b) includes or contains component (a). In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of a AAV-CRISPR complex to a different target sequence in a eukaryotic cell. In some embodiments, the eukaryotic host cell further comprises a third regulatory element, such as a polymerase III promoter, operably linked to said tracr sequence. In some embodiments, the tracr sequence exhibits at least 50%, 60%, 70%, 80%, 90%, 95%, or 99% of sequence complementarity along the length of the tracr mate sequence when optimally aligned. In some embodiments, the AAV-CRISPR enzyme comprises one or more nuclear localization sequences and/or nuclear export sequences of sufficient strength to drive accumulation of said CRISPR enzyme in a detectable amount in of the nucleus of a eukaryotic cell. In some embodiments, the AAV-CRISPR enzyme is a type II CRISPR system enzyme. In some embodiments, the CRISPR enzyme is a Cas enzyme. In some embodiments, the AAV-Cas enzyme is derived from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus Methanoplasma termitum, Eubacterium eligens, Moraxella bovoculi* 237, *Leptospira inadai*, Lachnospiraceae bacterium ND2006, *Porphyromonas crevioricanis* 3, *Prevotella disiens* and *Porphyromonas macacae* (e.g., Cas modified to have or be associated with at least one AAV), and may include further alteration or mutation of the Cas, and can be a chimeric Cas. In some embodiments, the AAV-CRISPR enzyme is codon-optimized for expression in a eukaryotic cell. In some embodiments, the AAV-CRISPR enzyme directs cleavage of one or two strands at the location of the target sequence. In some embodiments, the AAV-CRISPR enzyme lacks or substantially DNA strand cleavage activity (e.g., no more than 5% nuclease activity as compared with a wild type enzyme or enzyme not having the mutation or alteration that decreases nuclease activity). In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length. In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal, for example a mammal. Also, the organism may be an arthropod such as an insect. The organism also may be a plant. Further, the organism may be a fungus. Advantageously the organism is a host of AAV.

In one aspect, the invention provides a kit comprising one or more of the components described herein. In some embodiments, the kit comprises a vector system and instructions for using the kit. In some embodiments, the vector system comprises (a) a first regulatory element operably linked to a tracr mate sequence and one or more insertion sites for inserting one or more guide sequences upstream of the tracr mate sequence, wherein when expressed, the guide sequence directs sequence-specific binding of a CRISPR complex to a target sequence in a eukaryotic cell, wherein the CRISPR complex comprises a CRISPR enzyme complexed with (1) the guide sequence that is hybridized to the target sequence, and (2) the tracr mate sequence that is hybridized to the tracr sequence; and/or (b) said AAV-CRISPR enzyme optionally comprising a nuclear localization sequence. In some embodiments, the kit comprises components (a) and (b) located on or in the same or different vectors of the system, e.g., (a) can be contained in (b). In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the system further comprises a third regulatory element, such as a polymerase III promoter, operably linked to said tracr sequence. In some embodiments, the tracr sequence exhibits at least 50%, 60%, 70%, 80%, 90%, 95%, or 99% of sequence complementarity along the length of the tracr mate sequence when optimally aligned. In some embodiments, the CRISPR enzyme comprises one or more nuclear localization sequences of sufficient strength to drive accumulation of said CRISPR enzyme in a detectable amount in the nucleus of a eukaryotic cell. In some embodiments, the CRISPR enzyme is a type II CRISPR system enzyme. In some embodiments, the CRISPR enzyme is a Cas enzyme. In some embodiments, the Cas enzyme is derived from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus* Methanoplasma *termitum, Eubacterium eligens, Moraxella bovoculi* 237, *Leptospira inadai*, Lachnospiraceae bacterium ND2006, *Porphyromonas crevioricanis* 3, *Prevotella disiens* and *Porphyromonas macacae* (e.g., Cas modified to have or be associated with at least one AAV), and may include further alteration or mutation of the Cas, and can be a chimeric Cas. In some embodiments, the coding for the AAV-CRISPR enzyme is codon-optimized for expression in a eukaryotic cell. In some embodiments, the AAV-CRISPR enzyme directs cleavage of one or two strands at the location of the target sequence. In some embodiments, the AAV-CRISPR enzyme lacks or substantially DNA strand cleavage activity (e.g., no more than 5% nuclease activity as compared with a wild type enzyme or enzyme not having the mutation or alteration that decreases nuclease activity). In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length.

In one aspect, the invention provides a method of modifying a target polynucleotide in a eukaryotic cell. In some embodiments, the method comprises allowing a AAV-CRISPR complex to bind to the target polynucleotide, e.g., to effect cleavage of said target polynucleotide, thereby modifying the target polynucleotide, wherein the AAV-CRISPR complex comprises a AAV-CRISPR enzyme complexed with a guide sequence hybridized to a target sequence within said target polynucleotide, wherein said guide sequence is linked to a tracr mate sequence which in turn hybridizes to a tracr sequence. In some embodiments, said cleavage comprises cleaving one or two strands at the location of the target sequence by said AAV-CRISPR enzyme. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein one or more vectors comprise the AAV-CRISPR enzyme and one or more vectors drive expression of one or more of: the guide sequence linked to the tracr mate sequence, and the tracr sequence. In some embodiments, said AAV-CRISPR enzyme drive expression of one or more of: the guide sequence linked to the tracr mate sequence, and the tracr sequence. In some embodiments such AAV-CRISPR enzyme are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

In one aspect, the invention provides a method of modifying expression of a polynucleotide in a eukaryotic cell. In some embodiments, the method comprises allowing a AAV-CRISPR complex to bind to the polynucleotide such that said binding results in increased or decreased expression of said polynucleotide; wherein the AAV-CRISPR complex comprises a AAV-CRISPR enzyme complexed with a guide sequence hybridized to a target sequence within said polynucleotide, wherein said guide sequence is linked to a tracr mate sequence which in turn hybridizes to a tracr sequence. In some embodiments, the method further comprises delivering one or more vectors to said eukaryotic cells, wherein the one or more vectors are the AAV-CRISPR enzyme and/or drive expression of one or more of: the guide sequence linked to the tracr mate sequence, and the tracr sequence.

In one aspect, the invention provides a method of generating a model eukaryotic cell comprising a mutated disease gene. In some embodiments, a disease gene is any gene associated an increase in the risk of having or developing a disease. In some embodiments, the method comprises (a) introducing one or more vectors into a eukaryotic cell, wherein the one or more vectors comprise the AAV-CRISPR enzyme and/or drive expression of one or more of: a guide sequence linked to a tracr mate sequence, and a tracr sequence; and (b) allowing a AAV-CRISPR complex to bind to a target polynucleotide, e.g., to effect cleavage of the target polynucleotide within said disease gene, wherein the AAV-CRISPR complex comprises the AAV-CRISPR enzyme complexed with (1) the guide sequence that is hybridized to the target sequence within the target polynucleotide, and (2) the tracr mate sequence that is hybridized to the tracr sequence, thereby generating a model eukaryotic cell comprising a mutated disease gene. Thus, in some embodiments the AAV-CRISPR enzyme contains nucleic acid molecules for and drives expression of one or more of: a guide sequence linked to a tracr mate sequence, and a tracr sequence and/or a Homologous Recombination template and/or a stabilizing ligand if the CRISPR enzyme has a destabilization domain. In some embodiments, said cleavage comprises cleaving one or two strands at the location of the target sequence by said AAV-CRISPR enzyme. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence.

In one aspect, the invention provides a method for developing a biologically active agent that modulates a cell signaling event associated with a disease gene. In some embodiments, a disease gene is any gene associated an increase in the risk of having or developing a disease. In some embodiments, the method comprises (a) contacting a test compound with a model cell of any one of the described embodiments; and (b) detecting a change in a readout that is indicative of a reduction or an augmentation of a cell signaling event associated with said mutation in said disease gene, thereby developing said biologically active agent that modulates said cell signaling event associated with said disease gene.

In one aspect, the invention provides a recombinant polynucleotide comprising a guide sequence upstream of a tracr mate sequence, wherein the guide sequence when expressed directs sequence-specific binding of a AAV- CRISPR complex to a corresponding target sequence present in a eukaryotic cell. The polynucleotide can be carried within and expressed in vivo from the AAV-CRISPR enzyme. In some embodiments, the target sequence is a viral sequence present in a eukaryotic cell. In some embodiments, the target sequence is a proto-oncogene or an oncogene.

In one aspect the invention provides for a method of selecting one or more cell(s) by introducing one or more mutations in a gene in the one or more cell(s), the method comprising: introducing one or more vectors into the cell(s), wherein the one or more vectors comprise a AAV-CRISPR enzyme and/or drive expression of one or more of: a guide sequence linked to a tracr mate sequence, a tracr sequence, and an editing template; wherein, for example that which is being expressed is within and expressed in vivo by the AAV-CRISPR enzyme and/or the editing template comprises the one or more mutations that abolish AAV-CRISPR enzyme cleavage; allowing homologous recombination of the editing template with the target polynucleotide in the cell(s) to be selected; allowing a CRISPR complex to bind to a target polynucleotide to effect cleavage of the target polynucleotide within said gene, wherein the AAV-CRISPR complex comprises the AAV-CRISPR enzyme complexed with (1) the guide sequence that is hybridized to the target sequence within the target polynucleotide, and (2) the tracr mate sequence that is hybridized to the tracr sequence, wherein binding of the AAV-CRISPR complex to the target polynucleotide induces cell death, thereby allowing one or more cell(s) in which one or more mutations have been introduced to be selected. In a preferred embodiment, the AAV-CRISPR enzyme is AAV-Cas. In another aspect of the invention the cell to be selected may be a eukaryotic cell. Aspects of the invention allow for selection of specific cells without requiring a selection marker or a two-step process that may include a counter-selection system. The cell(s) may be prokaryotic or eukaryotic cells.

With respect to mutations of the AAV-CRISPR enzyme, mutations may be made at any or all residues corresponding to positions 908, 993, and 1263 with reference to amino acid position numbering of AsCpf1 (which may be ascertained for instance by standard sequence comparison tools), or 917 and 1006 with reference to amino acid numbering of FnCpf1, or 832, 925, 947, 1180 with reference to amino acid position numbering of LbCpf1. In particular, any or all of the following mutations are preferred in AsCpf1: D908A, E993A, and D1263; in FnCpf1: D917A and H1006A; in LbCpf1: D832A, E925A, D947A, and D1180A; as well as conservative substitution for any of the replacement amino acids is also envisaged. In an aspect the invention provides as to any or each or all embodiments herein-discussed wherein the AAV-CRISPR enzyme comprises at least one or more, or at least two or more mutations, wherein the at least one or more mutation or the at least two or more mutations is as to D908, E993, or D1263 according to AsCpf1 protein, e.g., D908A, E993A, or D1263 as to AsCpf1, or D917 or H1006 according to FnCpf1, e.g., D917A or H1006A as to FnCpf1, or D832, E925, D947, or D1180 according to LbCpf1, e.g., D832A, E925A, D947A, or D1180A as to LbCpf1, or any corresponding mutation(s) in a Cpf1 of an ortholog to As or Fn or Lb, or the CRISPR enzyme comprises at least one mutation wherein at least D908A, E993A, or D1263 as to AsCpf1 or D917A or H1006A as to FnCpf1 or D832A, E925A, D947A, or D1180A as to LbCpf1 is mutated; or any corresponding mutation(s) in a Cpf1 of an ortholog to As protein or Fn protein or Lb protein.

Aspects of the invention encompass a non-naturally occurring or engineered composition that may comprise a guide RNA (sgRNA) comprising a guide sequence capable of hybridizing to a target sequence in a genomic locus of interest in a cell and a AAV-CRISPR enzyme that may comprise at least one or more nuclear localization sequences, wherein the AAV-CRISPR enzyme comprises one or two or more mutations, such that the enzyme has altered or diminished nuclease activity compared with the wild type enzyme, wherein at least one loop of the sgRNA is modified by the insertion of distinct RNA sequence(s) that bind to one or more adaptor proteins, and wherein the adaptor protein further recruits one or more heterologous functional domains. In an embodiment of the invention the AAV-CRISPR enzyme comprises one or two or more mutations in a residue selected from the group comprising, consisting essentially of, or consisting of D908, E993, or D1263 according to AsCpf1 protein; D917 or H1006 according to FnCpf1; or D832, E925, D947, or D1180 according to LbCpf1. In a further embodiment the AAV-CRISPR enzyme comprises one or two or more mutations selected from the group comprising D908A, E993A, or D1263 as to AsCpf1; D917A or H1006A as to FnCpf1; or D832A, E925A, D947A, or D1180A as to LbCpf1. In another embodiment, the functional domain comprises, consists essentially of a transcriptional activation domain, e.g., VP64. In another embodiment, the functional domain comprises, consists essentially of a transcriptional repressor domain, e.g., KRAB domain, SID domain or a SID4X domain. In embodiments of the invention, the one or more heterologous functional domains have one or more activities selected from the group comprising, consisting essentially of, or consisting of methylase activity, demethylase activity, transcription activation activity, transcription repression activity, transcription release factor activity, histone modification activity, RNA cleavage activity and nucleic acid binding activity. In further embodiments of the invention the cell is a eukaryotic cell or a mammalian cell or a human cell. In another embodiment, the at least one loop of the sgRNA is tetraloop and/or loop2. An aspect of the invention encompasses methods of modifying a genomic locus of interest to change gene expression in a cell by introducing into the cell any of the compositions described herein. An aspect of the invention is that the above elements are comprised in a single composition or comprised in individual compositions, e.g., the AAV-CRISPR enzyme delivers the enzyme as discussed as well as the guide. These compositions may advantageously be applied to a host to elicit a functional effect on the genomic level. In general, the sgRNA are modified in a manner that provides specific binding sites (e.g., aptamers) for adapter proteins comprising one or more functional domains (e.g., via fusion protein) to bind to. The modified sgRNA are modified such that once the sgRNA forms a AAV-CRISPR complex (i.e. AAV-CRISPR enzyme binding to sgRNA and target) the adapter proteins bind and, the functional domain on the adapter protein is positioned in a spatial orientation which is advantageous for the attributed function to be effective. For example, if the functional domain comprise, consist essentially of a transcription activator (e.g., VP64 or p65), the transcription activator is placed in a spatial orientation which allows it to affect the transcription of the target. Likewise, a transcription repressor will be advantageously positioned to affect the transcription of the target and a nuclease (e.g., Fok1) will be advantageously positioned to cleave or partially cleave the target. Again, the AAV-CRISPR enzyme can deliver both the enzyme and the modified guide. The skilled person will understand that modifications to the sgRNA which allow for binding of the adapter+functional domain but not proper positioning of the adapter+functional domain (e.g., due to steric hindrance within the three dimensional structure of the CRISPR complex) are modifications which are not intended. The one or more modified sgRNA may be modified at the tetra loop, the stem loop 1, stem loop 2, or stem loop 3, as described herein, preferably at either the tetra loop or stem loop 2, and most preferably at both the tetra loop and stem loop 2.

As explained herein the functional domains may be, for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). In some cases, it is advantageous that additionally at least one NLS is provided. In some instances, it is advantageous to position the NLS at the N terminus. When more than one functional domain is included, the functional domains may be the same or different.

The sgRNA may be designed to include multiple binding recognition sites (e.g., aptamers) specific to the same or different adapter protein. The sgRNA may be designed to bind to the promoter region −1000- +1 nucleic acids upstream of the transcription start site (i.e. TSS), preferably −200 nucleic acids. This positioning improves functional domains which affect gene activation (e.g., transcription activators) or gene inhibition (e.g., transcription repressors). The modified sgRNA may be one or more modified sgRNAs targeted to one or more target loci (e.g., at least 1 sgRNA, at least 2 sgRNA, at least 5 sgRNA, at least 10 sgRNA, at least 20 sgRNA, at least 30 sg RNA, at least 50 sgRNA) comprised in a composition.

Further, the AAV-CRISPR enzyme with diminished nuclease activity is most effective when the nuclease activity is inactivated (e.g., nuclease inactivation of at least 70%, at least 80%, at least 90%, at least 95%, at least 97%, or 100% as compared with the wild type enzyme; or to put in another way, a AAV-Cas enzyme or AAV-CRISPR enzyme having advantageously about 0% of the nuclease activity of the non-mutated or wild type Cas enzyme or CRISPR enzyme, or no more than about 3% or about 5% or about 10% of the nuclease activity of the non-mutated or wild type Cas enzyme or CRISPR enzyme). This is possible by introducing mutations into the RuvC and HNH nuclease domains of the AsCpf1 and orthologs thereof. For example utilizing mutations in a residue selected from the group comprising, consisting essentially of, or consisting of D908, E993, or D1263 according to AsCpf1 protein; D917 or H1006 according to FnCpf1; or D832, E925, D947, or D1180 according to LbCpf1, and more preferably introducing one or more of the mutations selected from the group comprising, consisting essentially of, or consisting of D908A, E993A, or D1263 as to AsCpf1; D917A or H1006A as to FnCpf1; or D832A, E925A, D947A, or D1180A as to LbCpf1. The inactivated CRISPR enzyme may have associated (e.g., via fusion protein) one or more functional domains, e.g., at least one destabilizing domain; or, for instance like those as described herein for the modified sgRNA adaptor proteins, including for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, MyoD1. In the event that Fok1 is provided, it is advantageous that multiple Fok1 functional domains are provided to allow for a functional dimer and that sgRNAs are designed to provide proper spacing for functional use (Fok1) as specifically described in Tsai et al. Nature Biotechnology, Vol. 32, Number 6, June 2014). The adaptor protein may utilize known linkers to attach such functional domains. In some cases, it is advantageous that additionally at least one NLS is provided. In some instances, it is advantageous to position the NLS at the N terminus. When more than one functional domain is included, the functional domains may be the same or different. In general, the positioning of the one or more functional domain on the inactivated AAV-CRISPR enzyme is one which allows for correct spatial orientation for the functional domain to affect the target with the attributed functional effect. For example, if the functional domain is a transcription activator (e.g., VP64 or p65), the transcription activator is placed in a spatial orientation which allows it to affect the transcription of the target. Likewise, a transcription repressor will be advantageously positioned to affect the transcription of the target, and a nuclease (e.g., Fok1) will be advantageously positioned to cleave or partially cleave the target. This may include positions other than the N-/C-terminus of the AAV-CRISPR enzyme. Positioning the functional domain in the Rec domain, the Rec2 domain, the HNH domain, or the PI domain of the AsCpf1 protein or any ortholog corresponding to these domains is advantageous; and again, it is mentioned that the functional domain can be a DD. Positioning of the functional domains to the Rec domain or the Rec2 domain, of the AsCpf1 protein or any ortholog corresponding to these domains, in some instances may be preferred. Fok1 functional domain may be attached at the N terminus. When more than one functional domain is included, the functional domains may be the same or different.

An adaptor protein may be any number of proteins that binds to an aptamer or recognition site introduced into the modified sgRNA and which allows proper positioning of one or more functional domains, once the sgRNA has been incorporated into the AAV-CRISPR complex, to affect the target with the attributed function. As explained in detail in this application such may be coat proteins, preferably bacteriophage coat proteins. The functional domains associated with such adaptor proteins (e.g., in the form of fusion protein) may include, for example, one or more domains from the group comprising, consisting essentially of, or consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, MyoD1. In the event that the functional domain is a transcription activator or transcription repressor it is advantageous that additionally at least an NLS is provided and preferably at the N terminus. When more than one functional domain is included, the functional domains may be the same or different. The adaptor protein may utilize known linkers to attach such functional domains. Such linkers may be used to associate the AAV (e.g., capsid or VP2) with the CRISPR enzyme or have the CRISPR enzyme comprise the AAV (or vice versa).

Thus, sgRNA, e.g., modified sgRNA, the inactivated AAV-CRISPR enzyme (with or without functional domains), and the binding protein with one or more functional domains, may each individually be comprised in a composition and administered to a host individually or collectively. Alternatively, these components may be provided in a single composition for administration to a host, e.g., the AAV-CRISPR enzyme can deliver the RNA or guide or sgRNA or modified sgRNA and/or other components of the CRISPR system. Administration to a host may be performed via viral vectors, advantageously using the AAV-CRISPR enzyme as the delivery vehicle, although other vehicles can be used to deliver components other than the enzyme of the CRISPR system, and such viral vectors can be, for example, lentiviral vector, adenoviral vector, AAV vector. Several variations are appropriate to elicit a genomic locus event, including DNA cleavage, gene activation, or gene deactivation. Using the provided compositions, the person skilled in the art can advantageously and specifically target single or multiple loci with the same or different functional domains to elicit one or more genomic locus events. The compositions may be applied in a wide variety of methods for screening in libraries in cells and functional modeling in vivo (e.g., gene activation of lincRNA and identification of function; gain-of-function modeling; loss-of-function modeling; the use the compositions of the invention to establish cell lines and transgenic animals for optimization and screening purposes).

In an aspect, the invention provides a particle delivery system or the delivery system or the virus particle of any one of any one of the above embodiments or the cell of any one of the above embodiments for use in medicine or in therapy; or for use in a method of modifying an organism or a non-human organism by manipulation of a target sequence in a genomic locus associated with a disease or disorder; or for use in a method of treating or inhibiting a condition caused by one or more mutations in a genetic locus associated with a disease in a eukaryotic organism or a non-human organism.; or for use in in vitro, ex vivo or in vivo gene or genome editing; or for use in in vitro, ex vivo or in vivo gene therapy.

In an aspect, the invention provides a pharmaceutical composition comprising the particle delivery system or the delivery system or the virus particle of any one of the above embodiments or the cell of any one of the above embodiments.

In an aspect, the invention provides a method of treating or inhibiting a condition or a disease caused by one or more mutations in a genomic locus in a eukaryotic organism or a non-human organism comprising manipulation of a target sequence within a coding, non-coding or regulatory element of said genomic locus in a target sequence in a subject or a non-human subject in need thereof comprising modifying the subject or a non-human subject by manipulation of the target sequence and wherein the condition or disease is susceptible to treatment or inhibition by manipulation of the target sequence comprising providing treatment comprising delivering a composition comprising the particle delivery system or the delivery system or the virus particle of any one of the above embodiment or the cell of any one of the above embodiment.

In an aspect, the invention provides use of the particle delivery system or the delivery system or the virus particle of any one of the above embodiments or the cell of any one of the above embodiments in ex vivo or in vivo gene or genome editing; or for use in in vitro, ex vivo or in vivo gene therapy.

In an aspect, the invention provides use of the particle delivery system or the delivery system or the virus particle of any one of the above embodiment or the cell of any one of the above embodiment in the manufacture of a medicament for in vitro, ex vivo or in vivo gene or genome editing or for use in in vitro, ex vivo or in vivo gene therapy or for use in a method of modifying an organism or a non-human organism by manipulation of a target sequence in a genomic locus associated with a disease or in a method of treating or inhibiting a condition or disease caused by one or more mutations in a genomic locus in a eukaryotic organism or a non-human organism.

In an aspect, the invention provides a method of individualized or personalized treatment of a genetic disease in a subject in need of such treatment comprising:
(a) introducing one or more mutations ex vivo in a tissue, organ or a cell line, or in vivo in a transgenic non-human mammal, comprising delivering to cell(s) of the tissue, organ, cell or mammal a composition comprising the particle delivery system or the delivery system or the virus particle of any one of the above embodiment or the cell of any one of the above embodiment, wherein the specific mutations or precise sequence substitutions are or have been correlated to the genetic disease;
(b) testing treatment(s) for the genetic disease on the cells to which the vector has been delivered that have the specific mutations or precise sequence substitutions correlated to the genetic disease; and
(c) treating the subject based on results from the testing of treatment(s) of step (b).

In an aspect, the invention provides a method of modeling a disease associated with a genomic locus in a eukaryotic organism or a non-human organism comprising manipulation of a target sequence within a coding, non-coding or regulatory element of said genomic locus comprising delivering a non-naturally occurring or engineered composition comprising a viral vector system comprising one or more viral vectors operably encoding a composition for expression thereof, wherein the composition comprises particle delivery system or the delivery system or the virus particle of any one of the above embodiments or the cell of any one of the above embodiment.

In an aspect, the method provides a method of modifying an organism or a non-human organism by manipulation of a target sequence in a genomic locus of interest comprising administering a composition comprising the particle delivery system or the delivery system or the virus particle of any one of the above embodiments or the cell of any one of the above embodiments.

In any of the described methods the strand break may be a single strand break or a double strand break.

Regulatory elements may comprise inducible promotors. Polynucleotides and/or vector systems may comprise inducible systems.

The invention also provides a vector system comprising one or more vectors, the one or more vectors comprising one or more polynucleotide molecules encoding components of a non-naturally occurring or engineered composition which is a composition having the characteristics as discussed herein or defined in any of the herein described methods.

The invention also provides a non-naturally occurring or engineered composition, or one or more polynucleotides encoding components of said composition, or vector systems comprising one or more polynucleotides encoding components of said composition for use in a therapeutic method of treatment. The therapeutic method of treatment may comprise gene or genome editing, or gene therapy.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

In certain embodiments, a vector system includes promoter-guide expression cassette in reverse order.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

Advantageous vectors include lentiviruses and adeno-associated viruses, and types of such vectors can also be selected for targeting particular types of cells.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector module and a nucleic acid-targeting guide RNA could each be operably linked to separate regulatory elements on separate vectors. RNA(s) of the nucleic acid-targeting system can be delivered to a transgenic nucleic acid-targeting effector module animal or mammal, e.g., an animal or mammal that constitutively or inducibly or conditionally expresses nucleic acid-targeting effector module; or an animal or mammal that is otherwise expressing nucleic acid-targeting effector modules or has cells containing nucleic acid-targeting effector modules, such as by way of prior administration thereto of a vector or vectors that code for and express in vivo nucleic acid-targeting effector modules. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector module and the nucleic acid-targeting guide RNA, embedded within one or more intron sequences (e.g., each in a different intron, two or more in at least one intron, or all in a single intron). In some embodiments, the nucleic acid-targeting effector module and the nucleic acid-targeting guide RNA may be operably linked to and expressed from the same promoter.

In an aspect, the invention provides in a vector system comprising one or more vectors, wherein the one or more vectors comprises:
  a) a first regulatory element operably linked to a nucleotide sequence encoding the engineered CRISPR protein as defined herein; and optionally
  b) a second regulatory element operably linked to one or more nucleotide sequences encoding one or more nucleic acid molecules comprising a guide RNA comprising a guide sequence, a direct repeat sequence, optionally wherein components (a) and (b) are located on same or different vectors.

The invention also provides an engineered, non-naturally occurring Clustered Regularly Interspersed Short Palindromic Repeats (CRISPR)-CRISPR associated (Cas effector module) (CRISPR-Cas effector module) vector system comprising one or more vectors comprising:
  a) a first regulatory element operably linked to a nucleotide sequence encoding a non-naturally-occurring CRISPR enzyme of any one of the inventive constructs herein; and
  b) a second regulatory element operably linked to one or more nucleotide sequences encoding one or more of the guide RNAs, the guide RNA comprising a guide sequence, a direct repeat sequence,
  wherein:
    components (a) and (b) are located on same or different vectors,
    the CRISPR complex is formed;
    the guide RNA targets the target polynucleotide loci and the enzyme alters the polynucleotide loci, and
    the enzyme in the CRISPR complex has reduced capability of modifying one or more off-target loci as compared to an unmodified enzyme and/or whereby the enzyme in the CRISPR complex has increased capability of modifying the one or more target loci as compared to an unmodified enzyme.

As used herein, a CRISPR Cas effector module or CRISRP effector module includes, but is not limited to, Cas9, Cpf1, C2c2, Group 13b, and C2c1. In some embodiments, the CRISPR-Cas effector module may be engineered.

In such a system, component (II) may comprise a first regulatory element operably linked to a polynucleotide sequence which comprises the guide sequence, the direct repeat sequence, and wherein component (II) may comprise a second regulatory element operably linked to a polynucleotide sequence encoding the CRISPR enzyme. In such a system, where applicable the guide RNA may comprise a chimeric RNA.

In such a system, component (I) may comprise a first regulatory element operably linked to the guide sequence and the direct repeat sequence, and wherein component (II) may comprise a second regulatory element operably linked to a polynucleotide sequence encoding the CRISPR enzyme. Such a system may comprise more than one guide RNA, and each guide RNA has a different target whereby there is multiplexing. Components (a) and (b) may be on the same vector.

In any such systems comprising vectors, the one or more vectors may comprise one or more viral vectors, such as one or more retrovirus, lentivirus, adenovirus, adeno-associated virus or herpes simplex virus.

In any such systems comprising regulatory elements, at least one of said regulatory elements may comprise a tissue-specific promoter. The tissue-specific promoter may direct expression in a mammalian blood cell, in a mammalian liver cell or in a mammalian eye.

In any of the above-described compositions or systems the direct repeat sequence, may comprise one or more protein-interacting RNA aptamers. The one or more aptamers may be located in the tetraloop. The one or more aptamers may be capable of binding MS2 bacteriophage coat protein.

In any of the above-described compositions or systems the cell may be a eukaryotic cell or a prokaryotic cell; wherein the CRISPR complex is operable in the cell, and whereby the enzyme of the CRISPR complex has reduced capability of modifying one or more off-target loci of the cell as compared to an unmodified enzyme and/or whereby the enzyme in the CRISPR complex has increased capability of modifying the one or more target loci as compared to an unmodified enzyme.

The invention also provides a CRISPR complex of any of the above-described compositions or from any of the above-described systems.

The invention also provides a method of modifying a locus of interest in a cell comprising contacting the cell with any of the herein-described engineered CRISPR enzymes (e.g. engineered Cas effector module), compositions or any of the herein-described systems or vector systems, or wherein the cell comprises any of the herein-described CRISPR complexes present within the cell. In such methods the cell may be a prokaryotic or eukaryotic cell, preferably a eukaryotic cell. In such methods, an organism may comprise the cell. In such methods the organism may not be a human or other animal.

In certain embodiment, the invention also provides a non-naturally-occurring, engineered composition (e.g., engineered Cas9, Cpf1, C2c2, C2c1, Group 29/30, 13b, or any Cas protein which can fit into an AAV vector). Reference is made to FIGS. 19A, 19B, 19C, 19D, and 20A-F in U.S. Pat. No. 8,697,359 herein incorporated by reference to provide a list and guidance for other proteins which may also be used.

Any such method may be ex vivo or in vitro.

Effector Protein Acting as Nuclease

In some embodiments, the unmodified nucleic acid-targeting effector protein may have cleavage activity. In some embodiments, the RNA-targeting effector protein may direct cleavage of one or both nucleic acid (DNA or RNA) strands at the location of or near a target sequence, such as within the target sequence and/or within the complement of the target sequence or at sequences associated with the target sequence. In some embodiments, the nucleic acid-targeting effector protein may direct cleavage of one or both DNA or RNA strands within about 1, 2, 3, 4, 5, 6, 7, 8, 9, 10, 15, 20, 25, 50, 100, 200, 500, or more base pairs from the first or last nucleotide of a target sequence. In some embodiments, the cleavage may be staggered, i.e. generating sticky ends. In some embodiments, the cleavage is a staggered cut with a 5' overhang. In some embodiments, the cleavage is a staggered cut with a 5' overhang of 1 to 5 nucleotides, preferably of 4 or 5 nucleotides. In some embodiments, the cleavage site is distant from the PAM, e.g., the cleavage occurs after the 18th nucleotide on the non-target strand and after the 23rd nucleotide on the targeted strand. In some embodiments, the cleavage site occurs after the 18th nucleotide (counted from the PAM) on the non-target strand and after the 23rd nucleotide (counted from the PAM) on the targeted strand. In some embodiments, a vector encodes a nucleic acid-targeting effector protein that may be mutated with respect to a corresponding wild-type enzyme such that the mutated nucleic acid-targeting effector protein lacks the ability to cleave one or both DNA or RNA strands of a target polynucleotide containing a target sequence.

The methods according to the invention as described herein comprehend inducing one or more mutations in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s) or sgRNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 40, 45, 50, 75, 100, 200, 300, 400 or 500 nucleotides at each target sequence of said cell(s) via the guide(s) RNA(s) or sgRNA(s).

APPLICATIONS

Applications in Non-Human Organisms/Animals

In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal, for example a mammal. Also, the organism may be an arthropod such as an insect. The present invention may also be extended to other agricultural applications such as, for example, farm and production animals. For example, pigs have many features that make them attractive as biomedical models, especially in regenerative medicine. In particular, pigs with severe combined immunodeficiency (SCID) may provide useful models for regenerative medicine, xenotransplantation (discussed also elsewhere herein), and tumor development and will aid in developing therapies for human SCID patients. Lee et al., (Proc Natl Acad Sci USA. 2014 May 20;111(20):7260-5) utilized a reporter-guided transcription activator-like effector nuclease (TALEN) system to generated targeted modifications of recombination activating gene (RAG) 2 in somatic cells at high efficiency, including some that affected both alleles. The Cas effector protein may be applied to a similar system.

The methods of Lee et al., (Proc Natl Acad Sci USA. 2014 May 20;111(20):7260-5) may be applied to the present invention analogously as follows. Mutated pigs are produced by targeted modification of RAG2 in fetal fibroblast cells followed by SCNT and embryo transfer. Constructs coding for CRISPR Cas and a reporter are electroporated into fetal-derived fibroblast cells. After 48 h, transfected cells expressing the green fluorescent protein are sorted into individual wells of a 96-well plate at an estimated dilution of a single cell per well. Targeted modification of RAG2 is screened by amplifying a genomic DNA fragment flanking any CRISPR Cas cutting sites followed by sequencing the PCR products. After screening and ensuring lack of off-site mutations, cells carrying targeted modification of RAG2 are used for SCNT. The polar body, along with a portion of the adjacent cytoplasm of oocyte, presumably containing the metaphase II plate, are removed, and a donor cell are placed in the perivitelline. The reconstructed embryos are then electrically porated to fuse the donor cell with the oocyte and then chemically activated. The activated embryos are incubated in Porcine Zygote Medium 3 (PZM3) with 0.5 µM Scriptaid (S7817; Sigma-Aldrich) for 14-16 h. Embryos are then washed to remove the Scriptaid and cultured in PZM3 until they were transferred into the oviducts of surrogate pigs.

The present invention is also applicable to modifying SNPs of other animals, such as cows. Tan et al. (Proc Natl Acad Sci USA. 2013 Oct. 8; 110(41): 16526-16531) expanded the livestock gene editing toolbox to include transcription activator-like (TAL) effector nuclease (TALEN)- and clustered regularly interspaced short palindromic repeats (CRISPR)/Cas9-stimulated homology-directed repair (HDR) using plasmid, rAAV, and oligonucleotide templates. Gene specific gRNA sequences were cloned into the Church lab gRNA vector (Addgene ID: 41824) according to their methods (Mali P, et al. (2013) RNA-Guided Human Genome Engineering via Cas9. Science 339(6121):823-826). The Cas9 nuclease was provided either by co-transfection of the hCas9 plasmid (Addgene ID: 41815) or mRNA synthesized from RCIScript-hCas9. This RCIScript-hCas9 was constructed by sub-cloning the XbaI-AgeI fragment from the hCas9 plasmid (encompassing the hCas9 cDNA) into the RCIScript plasmid.

Heo et al. (Stem Cells Dev. 2015 Feb. 1; 24(3):393-402. doi: 10.1089/scd.2014.0278. Epub 2014 Nov. 3) reported highly efficient gene targeting in the bovine genome using bovine pluripotent cells and clustered regularly interspaced short palindromic repeat (CRISPR)/Cas9 nuclease. First, Heo et al. generate induced pluripotent stem cells (iPSCs) from bovine somatic fibroblasts by the ectopic expression of yamanaka factors and GSK3β and MEK inhibitor (2i) treatment. Heo et al. observed that these bovine iPSCs are highly similar to naïve pluripotent stem cells with regard to gene expression and developmental potential in teratomas. Moreover, CRISPR-Cas9 nuclease, which was specific for the bovine NANOG locus, showed highly efficient editing of the bovine genome in bovine iPSCs and embryos.

Igenity® provides a profile analysis of animals, such as cows, to perform and transmit traits of economic traits of economic importance, such as carcass composition, carcass quality, maternal and reproductive traits and average daily gain. The analysis of a comprehensive Igenity® profile begins with the discovery of DNA markers (most often single nucleotide polymorphisms or SNPs). All the markers behind the Igenity® profile were discovered by independent scientists at research institutions, including universities, research organizations, and government entities such as USDA. Markers are then analyzed at Igenity® in validation populations. Igenity® uses multiple resource populations that represent various production environments and biological types, often working with industry partners from the seedstock, cow-calf, feedlot and/or packing segments of the beef industry to collect phenotypes that are not commonly available. Cattle genome databases are widely available, see, e.g., the NAGRP Cattle Genome Coordination Program (www.animalgenome.org/cattle/maps/db.html). Thus, the present invention maybe applied to target bovine SNPs. One of skill in the art may utilize the above protocols for targeting SNPs and apply them to bovine SNPs as described, for example, by Tan et al. or Heo et al.

Qingjian Zou et al. (Journal of Molecular Cell Biology Advance Access published Oct. 12, 2015) demonstrated increased muscle mass in dogs by targeting the first exon of the dog Myostatin (MSTN) gene (a negative regulator of skeletal muscle mass). First, the efficiency of the sgRNA was validated, using cotransfection of the sgRNA targeting MSTN with a Cas9 vector into canine embryonic fibroblasts (CEFs). Thereafter, MSTN KO dogs were generated by micro-injecting embryos with normal morphology with a mixture of Cas9 mRNA and MSTN sgRNA and autotransplantation of the zygotes into the oviduct of the same female dog. The knock-out puppies displayed an obvious muscular phenotype on thighs compared with its wild-type littermate sister. This can also be performed using the Cas CRISPR systems provided herein.

Livestock—Pigs

Viral targets in livestock may include, in some embodiments, porcine CD163, for example on porcine macrophages. CD163 is associated with infection (thought to be through viral cell entry) by PRRSv (Porcine Reproductive and Respiratory Syndrome virus, an arterivirus). Infection by PRRSv, especially of porcine alveolar macrophages (found in the lung), results in a previously incurable porcine syndrome ("Mystery swine disease" or "blue ear disease") that causes suffering, including reproductive failure, weight loss and high mortality rates in domestic pigs. Opportunistic infections, such as enzootic pneumonia, meningitis and ear oedema, are often seen due to immune deficiency through loss of macrophage activity. It also has significant economic and environmental repercussions due to increased antibiotic use and financial loss (an estimated $660 m per year).

As reported by Kristin M Whitworth and Dr Randall Prather et al. (Nature Biotech 3434 published online 7 Dec. 2015) at the University of Missouri and in collaboration with Genus Plc, CD163 was targeted using CRISPR-Cas9 and the offspring of edited pigs were resistant when exposed to PRRSv. One founder male and one founder female, both of whom had mutations in exon 7 of CD163, were bred to produce offspring. The founder male possessed an 11-bp deletion in exon 7 on one allele, which results in a frameshift mutation and missense translation at amino acid 45 in domain 5 and a subsequent premature stop codon at amino acid 64. The other allele had a 2-bp addition in exon 7 and a 377-bp deletion in the preceding intron, which were predicted to result in the expression of the first 49 amino acids of domain 5, followed by a premature stop code at amino acid 85. The sow had a 7 bp addition in one allele that when translated was predicted to express the first 48 amino acids of domain 5, followed by a premature stop codon at amino acid 70. The sow's other allele was unamplifiable. Selected offspring were predicted to be a null animal (CD163−/−), i.e. a CD163 knock out.

Accordingly, in some embodiments, porcine alveolar macrophages may be targeted by the CRISPR protein. In some embodiments, porcine CD163 may be targeted by the CRISPR protein. In some embodiments, porcine CD163 may be knocked out through induction of a DSB or through insertions or deletions, for example targeting deletion or modification of exon 7, including one or more of those described above, or in other regions of the gene, for example deletion or modification of exon 5.

An edited pig and its progeny are also envisaged, for example a CD163 knock out pig. This may be for livestock, breeding or modelling purposes (i.e. a porcine model). Semen comprising the gene knock out is also provided.

CD163 is a member of the scavenger receptor cysteine-rich (SRCR) superfamily. Based on in vitro studies SRCR domain 5 of the protein is the domain responsible for unpackaging and release of the viral genome. As such, other members of the SRCR superfamily may also be targeted in order to assess resistance to other viruses. PRRSV is also a member of the mammalian arterivirus group, which also includes murine lactate dehydrogenase-elevating virus, simian hemorrhagic fever virus and equine arteritis virus. The arteriviruses share important pathogenesis properties, including macrophage tropism and the capacity to cause both severe disease and persistent infection. Accordingly, arteriviruses, and in particular murine lactate dehydrogenase-elevating virus, simian hemorrhagic fever virus and equine arteritis virus, may be targeted, for example through porcine CD163 or homologues thereof in other species, and murine, simian and equine models and knockout also provided.

Indeed, this approach may be extended to viruses or bacteria that cause other livestock diseases that may be transmitted to humans, such as Swine Influenza Virus (SIV) strains which include influenza C and the subtypes of influenza A known as H1N1, H1N2, H2N1, H3N1, H3N2, and H2N3, as well as pneumonia, meningitis and oedema mentioned above.

Treating Pathogens, Like Viral Pathogens Such as HIV

Cas-mediated genome editing might be used to introduce protective mutations in somatic tissues to combat nongenetic or complex diseases. For example, NHEJ-mediated inactivation of the CCR5 receptor in lymphocytes (Lombardo et al., Nat Biotechnol. 2007 November; 25(11):1298-306) may be a viable strategy for circumventing HIV infection, whereas deletion of PCSK9 (Cohen et al., Nat Genet. 2005 February; 37(2):161-5) orangiopoietin (Musunuru et al., N Engl J Med. 2010 Dec. 2; 363(23):2220-7) may provide therapeutic effects against statin-resistant hypercholesterolemia or hyperlipidemia. Although these targets may be also addressed using siRNA-mediated protein knockdown, a unique advantage of NHEJ-mediated gene inactivation is the ability to achieve permanent therapeutic benefit without the need for continuing treatment. As with all gene therapies, it will of course be important to establish that each proposed therapeutic use has a favorable benefit-risk ratio.

Hydrodynamic delivery of plasmid DNA encoding Cas9 nd guide RNA along with a repair template into the liver of an adult mouse model of tyrosinemia was shown to be able to correct the mutant Fah gene and rescue expression of the wild-type Fah protein in ~1 out of 250 cells (Nat Biotechnol. 2014 June; 32(6):551-3). In addition, clinical trials successfully used ZF nucleases to combat HIV infection by ex vivo knockout of the CCR5 receptor. In all patients, HIV DNA levels decreased, and in one out of four patients, HIV RNA became undetectable (Tebas et al., N Engl J Med. 2014 Mar. 6; 370(10):901-10). Both of these results demonstrate the promise of programmable nucleases as a new therapeutic platform.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CRISPR-Cas system of the present invention. A minimum of 2.5×106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin,Takara Bio Inc.).

With the knowledge in the art and the teachings in this disclosure the skilled person can correct HSCs as to immunodeficiency condition such as HIV/AIDS comprising contacting an HSC with a CRISPR-Cas system that targets and knocks out CCR5. A guide RNA (and advantageously a dual guide approach, e.g., a pair of different guide RNAs; for instance, guide RNAs targeting of two clinically relevant genes, B2M and CCR5, in primary human CD4+ T cells and CD34+ hematopoietic stem and progenitor cells (HSPCs)) that targets and knocks out CCR5-and-Cas protein containing particle is contacted with HSCs. The so contacted cells can be administered; and optionally treated/expanded; cf. Cartier. See also Kiem, "Hematopoietic stem cell-based gene therapy for HIV disease," Cell Stem Cell. Feb. 3, 2012; 10(2): 137-147; incorporated herein by reference along with the documents it cites; Mandal et al, "Efficient Ablation of Genes in Human Hematopoietic Stem and Effector Cells using CRISPR/Cas9," Cell Stem Cell, Volume 15, Issue 5, p643-652, 6 Nov. 2014; incorporated herein by reference along with the documents it cites. Mention is also made of Ebina, "CRISPR/Cas9 system to suppress HIV-1 expression by editing HIV-1 integrated proviral DNA" SCIENTIFIC REPORTS | 3: 2510 | DOI: 10.1038/srep02510, incorporated herein by reference along with the documents it cites, as another means for combatting HIV/AIDS using a CRISPR-Cas system.

The rationale for genome editing for HIV treatment originates from the observation that individuals homozygous for loss of function mutations in CCR5, a cellular co-receptor for the virus, are highly resistant to infection and otherwise healthy, suggesting that mimicking this mutation with genome editing could be a safe and effective therapeutic strategy [Liu, R., et al. Cell 86, 367-377 (1996)]. This idea was clinically validated when an HIV infected patient was given an allogeneic bone marrow transplant from a donor homozygous for a loss of function CCR5 mutation, resulting in undetectable levels of HIV and restoration of normal CD4 T-cell counts [Hutter, G., et al. The New England journal of medicine 360, 692-698 (2009)]. Although bone marrow transplantation is not a realistic treatment strategy for most HIV patients, due to cost and potential graft vs. host disease, HIV therapies that convert a patient's own T-cells into CCR5 are desirable.

Early studies using ZFNs and NHEJ to knockout CCR5 in humanized mouse models of HIV showed that transplantation of CCR5 edited CD4 T cells improved viral load and CD4 T-cell counts [Perez, E. E., et al. Nature biotechnology 26, 808-816 (2008)]. Importantly, these models also showed that HIV infection resulted in selection for CCR5 null cells, suggesting that editing confers a fitness advantage and potentially allowing a small number of edited cells to create a therapeutic effect.

As a result of this and other promising preclinical studies, genome editing therapy that knocks out CCR5 in patient T cells has now been tested in humans [Holt, N., et al. Nature biotechnology 28, 839-847 (2010); Li, L., et al. Molecular therapy: the journal of the American Society of Gene Therapy 21, 1259-1269 (2013)]. In a recent phase I clinical trial, CD4+ T cells from patients with HIV were removed, edited with ZFNs designed to knockout the CCR5 gene, and autologously transplanted back into patients [Tebas, P., et al. The New England journal of medicine 370, 901-910 (2014)].

In another study (Mandal et al., Cell Stem Cell, Volume 15, Issue 5, p643-652, 6 Nov. 2014), CRISPR-Cas9 has targeted two clinically relevant genes, B2M and CCR5, in human CD4+ T cells and CD34+ hematopoietic stem and progenitor cells (HSPCs). Use of single RNA guides led to highly efficient mutagenesis in HSPCs but not in T cells. A dual guide approach improved gene deletion efficacy in both cell types. HSPCs that had undergone genome editing with CRISPR-Cas9 retained multilineage potential. Predicted on- and off-target mutations were examined via target capture sequencing in HSPCs and low levels of off-target mutagenesis were observed at only one site. These results demonstrate that CRISPR-Cas9 can efficiently ablate genes in HSPCs with minimal off-target mutagenesis, which have broad applicability for hematopoietic cell-based therapy.

Wang et al. (PLoS One. 2014 Dec. 26; 9(12):e115987. doi: 10.1371/journal.pone.0115987) silenced CCR5 via CRISPR associated protein 9 (Cas9) and single guided RNAs (guide RNAs) with lentiviral vectors expressing Cas9 and CCR5 guide RNAs. Wang et al. showed that a single round transduction of lentiviral vectors expressing Cas9 and CCR5 guide RNAs into HIV-1 susceptible human CD4+ cells yield high frequencies of CCR5 gene disruption. CCR5 gene-disrupted cells are not only resistant to R5-tropic HIV-1, including transmitted/founder (T/F) HIV-1 isolates, but also have selective advantage over CCR5 gene-undisrupted cells during R5-tropic HIV-1 infection. Genome mutations at potential off-target sites that are highly homologous to these CCR5 guide RNAs in stably transduced cells even at 84 days post transduction were not detected by a T7 endonuclease I assay.

Fine et al. (Sci Rep. 2015 Jul. 1; 5:10777. doi: 10.1038/srep10777) identified a two-cassette system expressing pieces of the *S. pyogenes* Cas9 (SpCas9) protein which splice together in cellula to form a functional protein capable of site-specific DNA cleavage. With specific CRISPR guide strands, Fine et al. demonstrated the efficacy of this system in cleaving the HBB and CCR5 genes in human HEK-293T cells as a single Cas9 and as a pair of Cas9 nickases. The trans-spliced SpCas9 (tsSpCas9) displayed ~35% of the nuclease activity compared with the wild-type SpCas9 (wtSpCas9) at standard transfection doses, but had substantially decreased activity at lower dosing levels. The greatly reduced open reading frame length of the tsSpCas9 relative to wtSpCas9 potentially allows for more complex and longer genetic elements to be packaged into an AAV vector including tissue-specific promoters, multiplexed guide RNA expression, and effector domain fusions to SpCas9.

Li et al. (J Gen Virol. 2015 August; 96(8):2381-93. doi: 10.1099/vir.0.000139. Epub 2015 Apr. 8) demonstrated that CRISPR-Cas9 can efficiently mediate the editing of the CCR5 locus in cell lines, resulting in the knockout of CCR5 expression on the cell surface. Next-generation sequencing revealed that various mutations were introduced around the predicted cleavage site of CCR5. For each of the three most effective guide RNAs that were analyzed, no significant off-target effects were detected at the 15 top-scoring potential sites. By constructing chimeric Ad5F35 adenoviruses carrying CRISPR-Cas9 components, $L^1$ et al. efficiently transduced primary CD4+T-lymphocytes and disrupted CCR5 expression, and the positively transduced cells were conferred with HIV-1 resistance.

One of skill in the art may utilize the above studies of, for example, Holt, N., et al. Nature biotechnology 28, 839-847 (2010), Li, L., et al. Molecular therapy: the journal of the American Society of Gene Therapy 21, 1259-1269 (2013), Mandal et al., Cell Stem Cell, Volume 15, Issue 5, p643-652, 6 Nov. 2014, Wang et al. (PLoS One. 2014 Dec. 26; 9(12):e115987. doi: 10.1371/journal.pone.0115987), Fine et al. (Sci Rep. 2015 Jul. 1; 5:10777. doi: 10.1038/srep10777) and $L^1$ et al. (J Gen Virol. 2015 August; 96(8):2381-93. doi: 10.1099/vir.0.000139. Epub 2015 Apr. 8) for targeting CCR5 with the CRISPR Cas system of the present invention.

Treating Pathogens, Like Viral Pathogens, Such as HBV

The present invention may also be applied to treat hepatitis B virus (HBV). However, the CRISPR Cas system must be adapted to avoid the shortcomings of RNAi, such as the risk of oversatring endogenous small RNA pathways, by for example, optimizing dose and sequence (see, e.g., Grimm et al., Nature vol. 441, 26 May 2006). For example, low doses, such as about $1-10 \times 1014$ particles per human are contemplated. In another embodiment, the CRISPR Cas system directed against HBV may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of CRISPR Cas targeted to HBV RNA in a SNALP are contemplated. The daily treatment may be over about three days and then weekly for about five weeks. In another embodiment, the system of Chen et al. (Gene Therapy (2007) 14, 11-19) may be used/and or adapted for the CRISPR Cas system of the present invention. Chen et al. use a double-stranded adenoassociated virus 8-pseudotyped vector (dsAAV2/8) to deliver shRNA. A single administration of dsAAV2/8 vector ($1 \times 1012$ vector genomes per mouse), carrying HBV-specific shRNA, effectively suppressed the steady level of HBV protein, mRNA and replicative DNA in liver of HBV transgenic mice, leading to up to 2-3 log 10 decrease in HBV load in the circulation. Significant HBV suppression sustained for at least 120 days after vector administration. The therapeutic effect of shRNA was target sequence dependent and did not involve activation of interferon. For the present invention, a CRISPR Cas system directed to HBV may be cloned into an AAV vector, such as a dsAAV2/8 vector and administered to a human, for example, at a dosage of about 1×1015 vector genomes to about 1×1016 vector genomes per human. In another embodiment, the method of Wooddell et al. (Molecular Therapy vol. 21 no. 5, 973-985 May 2013) may be used/and or adapted to the CRISPR Cas system of the present invention. Wooddell et al. show that simple coinjection of a hepatocyte-targeted, N-acetylgalactosamine-conjugated melittin-like peptide (NAG-MLP) with a liver-tropic cholesterol-conjugated siRNA (chol-siRNA) targeting coagulation factor VII (F7) results in efficient F7 knockdown in mice and nonhuman primates without changes in clinical chemistry or induction of cytokines. Using transient and transgenic mouse models of HBV infection, Wooddell et al. show that a single coinjection of NAG-MLP with potent chol-siRNAs targeting conserved HBV sequences resulted in multilog repression of viral RNA, proteins, and viral DNA with long duration of effect. Intraveinous coinjections, for example, of about 6 mg/kg of NAG-MLP and 6 mg/kg of HBV specific CRISPR Cas may be envisioned for the present invention. In the alternative, about 3 mg/kg of NAG-MLP and 3 mg/kg of HBV specific CRISPR Cas may be delivered on day one, followed by administration of about about 2-3 mg/kg of NAG-MLP and 2-3 mg/kg of HBV specific CRISPR Cas two weeks later.

In some embodiments, the target sequence is an HBV sequence. In some embodiments, the target sequences is comprised in an episomal viral nucleic acid molecule which is not integrated into the genome of the organism to thereby manipulate the episomal viral nucleic acid molecule. In some embodiments, the episomal nucleic acid molecule is a double-stranded DNA polynucleotide molecule or is a covalently closed circular DNA (cccDNA). In some embodiments, the CRISPR complex is capable of reducing the amount of episomal viral nucleic acid molecule in a cell of the organism compared to the amount of episomal viral nucleic acid molecule in a cell of the organism in the absence of providing the complex, or is capable of manipulating the episomal viral nucleic acid molecule to promote degradation of the episomal nucleic acid molecule. In some embodiments, the target HBV sequence is integrated into the genome of the organism. In some embodiments, when formed within the cell, the CRISPR complex is capable of manipulating the integrated nucleic acid to promote excision of all or part of the target HBV nucleic acid from the genome of the organism. In some embodiments, said at least one target HBV nucleic acid is comprised in a double-stranded DNA polynucleotide cccDNA molecule and/or viral DNA integrated into the genome of the organism and wherein the CRISPR complex manipulates at least one target HBV nucleic acid to cleave viral cccDNA and/or integrated viral DNA. In some embodiments, said cleavage comprises one or more double-strand break(s) introduced into the viral cccDNA and/or integrated viral DNA, optionally at least two double-strand break(s). In some embodiments, said cleavage is via one or more single-strand break(s) introduced into the viral cccDNA and/or integrated viral DNA, optionally at least two single-strand break(s). In some embodiments, said one or more double-strand break(s) or said one or more single-strand break(s) leads to the formation of one or more insertion or deletion mutations (INDELs) in the viral cccDNA sequences and/or integrated viral DNA sequences.

Lin et al. (Mol Ther Nucleic Acids. 2014 Aug. 19; 3:e186. doi: 10.1038/mtna.2014.38) designed eight gRNAs against HBV of genotype A. With the HBV-specific gRNAs, the CRISPR-Cas9 system significantly reduced the production of HBV core and surface proteins in Huh-7 cells transfected with an HBV-expression vector. Among eight screened gRNAs, two effective ones were identified. One gRNA targeting the conserved HBV sequence acted against different genotypes. Using a hydrodynamics-HBV persistence mouse model, Lin et al. further demonstrated that this system could cleave the intrahepatic HBV genome-containing plasmid and facilitate its clearance in vivo, resulting in reduction of serum surface antigen levels. These data suggest that the CRISPR-Cas9 system could disrupt the HBV-expressing templates both in vitro and in vivo, indicating its potential in eradicating persistent HBV infection.

Dong et al. (Antiviral Res. 2015 June;118:110-7. doi: 10.1016/j.antiviral.2015.03.015. Epub 2015 Apr. 3) used the CRISPR-Cas9 system to target the HBV genome and efficiently inhibit HBV infection. Dong et al. synthesized four single-guide RNAs (guide RNAs) targeting the conserved regions of HBV. The expression of these guide RNAS with Cas9 reduced the viral production in Huh7 cells as well as in HBV-replication cell HepG2.2.15. Dong et al. further demonstrated that CRISPR-Cas9 direct cleavage and cleavage-mediated mutagenesis occurred in HBV cccDNA of transfected cells. In the mouse model carrying HBV cccDNA, injection of guide RNA-Cas9 plasmids via rapid tail vein resulted in the low level of cccDNA and HBV protein.

Liu et al. (J Gen Virol. 2015 August; 96(8):2252-61. doi: 10.1099/vir.0.000159. Epub 2015 Apr. 22) designed eight guide RNAs (gRNAs) that targeted the conserved regions of different HBV genotypes, which could significantly inhibit HBV replication both in vitro and in vivo to investigate the possibility of using the CRISPR-Cas9 system to disrupt the HBV DNA templates. The HBV-specific gRNA/Cas system could inhibit the replication of HBV of different genotypes in cells, and the viral DNA was significantly reduced by a single gRNA/Cas system and cleared by a combination of different gRNA/Cas systems.

Wang et al. (World J Gastroenterol. 2015 Aug. 28; 21(32): 9554-65. doi: 10.3748/wjg.v21.i32.9554) designed 15 gRNAs against HBV of genotypes A-D. Eleven combinations of two above gRNAs (dual-gRNAs) covering the regulatory region of HBV were chosen. The efficiency of each gRNA and 11 dual-gRNAs on the suppression of HBV (genotypes A-D) replication was examined by the measurement of HBV surface antigen (HBsAg) or e antigen (HBeAg) in the culture supernatant. The destruction of HBV-expressing vector was examined in HuH7 cells co-transfected with dual-gRNAs and HBV-expressing vector using polymerase chain reaction (PCR) and sequencing method, and the destruction of cccDNA was examined in HepAD38 cells using KCl precipitation, plasmid-safe ATP-dependent DNase (PSAD) digestion, rolling circle amplification and quantitative PCR combined method. The cytotoxicity of these gRNAs was assessed by a mitochondrial tetrazolium assay. All of gRNAs could significantly reduce HBsAg or HBeAg production in the culture supernatant, which was dependent on the region in which gRNA against. All of dual gRNAs could efficiently suppress HBsAg and/or HBeAg production for HBV of genotypes A-D, and the efficacy of dual gRNAs in suppressing HBsAg and/or HBeAg production was significantly increased when compared to the single gRNA used alone. Furthermore, by PCR direct sequencing we confirmed that these dual gRNAs could specifically destroy HBV expressing template by removing the fragment between the cleavage sites of the two used gRNAs. Most importantly, gRNA-5 and gRNA-12 combination not only could efficiently suppress HBsAg and/or HBeAg production, but also destroy the cccDNA reservoirs in HepAD38 cells.

Karimova et al. (Sci Rep. 2015 Sep. 3; 5:13734. doi: 10.1038/srep13734) identified cross-genotype conserved HBV sequences in the S and X region of the HBV genome that were targeted for specific and effective cleavage by a Cas9 nickase. This approach disrupted not only episomal cccDNA and chromosomally integrated HBV target sites in reporter cell lines, but also HBV replication in chronically and de novo infected hepatoma cell lines.

One of skill in the art may utilize the above studies of, for example, Lin et al. (Mol Ther Nucleic Acids. 2014 Aug. 19; 3:e186. doi: 10.1038/mtna.2014.38), Dong et al. (Antiviral Res. 2015 June;118:110-7. doi: 10.1016/j.antiviral.2015.03.015. Epub 2015 Apr. 3), Liu et al. (J Gen Virol. 2015 August;96(8):2252-61. doi: 10.1099/vir.0.000159. Epub 2015 Apr. 22), Wang et al. (World J Gastroenterol. 2015 Aug. 28; 21(32):9554-65. doi: 10.3748/wjg.v21.i32.9554) and Karimova et al. (Sci Rep. 2015 Sep. 3; 5:13734. doi: 10.1038/srep13734) for targeting HBV with the CRISPR Cas system of the present invention.

Chronic hepatitis B virus (HBV) infection is prevalent, deadly, and seldom cured due to the persistence of viral episomal DNA (cccDNA) in infected cells. Ramanan et al. (Ramanan V, Shlomai A, Cox DB, Schwartz R E, Michailidis E, Bhatta A, Scott D A, Zhang F, Rice C M, Bhatia S N, .Sci Rep. 2015 Jun. 2; 5:10833. doi: 10.1038/srep10833, published online 2nd June 2015.) showed that the CRISPR/Cas9 system can specifically target and cleave conserved regions in the HBV genome, resulting in robust suppression of viral gene expression and replication. Upon sustained expression of Cas9 and appropriately chosen guide RNAs, they demonstrated cleavage of cccDNA by Cas9 and a dramatic reduction in both cccDNA and other parameters of viral gene expression and replication. Thus, they showed that directly targeting viral episomal DNA is a novel therapeutic approach to control the virus and possibly cure patients. This is also described in WO2015089465 Al, in the name of The Broad Institute et al., the contents of which are hereby incorporated by reference As such targeting viral episomal DNA in HBV is preferred in some embodiments.

The present invention may also be applied to treat pathogens, e.g. bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

The present invention may also be applied to treat hepatitis C virus (HCV). The methods of Roelvinki et al. (Molecular Therapy vol. 20 no. 9, 1737-1749 September 2012) may be applied to the CRISPR Cas system. For example, an AAV vector such as AAV8 may be a contemplated vector and for example a dosage of about $1.25 \times 10^{11}$ to $1.25 \times 10^{13}$ vector genomes per kilogram body weight (vg/kg) may be contemplated. The present invention may also be applied to treat pathogens, e.g. bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

Jiang et al. ("RNA-guided editing of bacterial genomes using CRISPR-Cas systems," Nature Biotechnology vol. 31, p. 233-9, March 2013) used a CRISPR-Cas9 system to mutate or kill *S. pneumoniae* and *E. coli*. The work, which introduced precise mutations into the genomes, relied on dual-RNA:Cas9-directed cleavage at the targeted genomic site to kill unmutated cells and circumvented the need for selectable markers or counter-selection systems. CRISPR systems have be used to reverse antibiotic resistance and eliminate the transfer of resistance between strains. Bickard et al. showed that Cas9, reprogrammed to target virulence genes, kills virulent, but not avirulent, *S. aureus*. Reprogramming the nuclease to target antibiotic resistance genes destroyed staphylococcal plasmids that harbor antibiotic resistance genesand immunized against the spread of plasmid-borne resistance genes. (see, Bikard et al., "Exploiting CRISPR-Cas nucleases to produce sequence-specific antimicrobials," Nature Biotechnology vol. 32, 1146-1150, doi: 10.1038/nbt.3043, published online 5 Oct. 2014.) Bikard showed that CRISPR-Cas9 antimicrobials function in vivo to kill *S. aureus* in a mouse skin colonization model. Similarly, Yosef et al used a CRISPR system to target genes encoding enzymes that confer resistance to β-lactam antibiotics (see Yousef et al., "Temperate and lytic bacteriophages programmed to sensitize and kill antibiotic-resistant bacteria," Proc. Natl. Acad. Sci. USA, vol. 112, p. 7267-7272, doi: 10.1073/pnas.1500107112 published online May 18, 2015).

CRISPR systems can be used to edit genomes of parasites that are resistant to other genetic approaches. For example, a CRISPR-Cas9 system was shown to introduce double-stranded breaks into the in the *Plasmodium yoelii* genome (see, Zhang et al., "Efficient Editing of Malaria Parasite Genome Using the CRISPR/Cas9 System," mBio. vol. 5, e01414-14, July-August 2014). Ghorbal et al. ("Genome editing in the human malaria parasite *Plasmodium* falciparumusing the CRISPR-Cas9 system," Nature Biotechnology, vol. 32, p. 819-821, doi: 10.1038/nbt.2925, published online Jun. 1, 2014) modified the sequences of two genes, orc1 and kelch13, which have putative roles in gene silencing and emerging resistance to artemisinin, respectively. Parasites that were altered at the appropriate sites were recovered with very high efficiency, despite there being no direct selection for the modification, indicating that neutral or even deleterious mutations can be generated using this system. CRISPR-Cas9 is also used to modify the genomes of other pathogenic parasites, including *Toxoplasma gondii* (see Shen et al., "Efficient gene disruption in diverse strains of *Toxoplasma gondii* using CRISPR/CAS9," mBio vol. 5:e01114-14, 2014; and Sidik et al., "Efficient Genome Engineering of *Toxoplasma gondii* Using CRISPR/Cas9," PLoS One vol. 9, e100450, doi: 10.1371/journal.pone.0100450, published online Jun. 27, 2014).

Vyas et al. ("A *Candida albicans* CRISPR system permits genetic engineering of essential genes and gene families," Science Advances, vol. 1, e1500248, DOI: 10.1126/sciadv.1500248, Apr. 3, 2015) employed a CRISPR system to overcome long-standing obstacles to genetic engineering in *C. albicans* and efficiently mutate in a single experiment both copies of several different genes. In an organism where several mechanisms contribute to drug resistance, Vyas produced homozygous double mutants that no longer displayed the hyper-resistance to fluconazole or cycloheximide displayed by the parental clinical isolate Can90. Vyas also obtained homozygous loss-of-function mutations in essential genes of *C. albicans* by creating conditional alleles. Null alleles of DCR1, which is required for ribosomal RNA processing, are lethal at low temperature but viable at high temperature. Vyas used a repair template that introduced a nonsense mutation and isolated dcr1/dcr1 mutants that failed to grow at 16° C.

Treating Diseases with Genetic or Epigenetic Aspects

The CRISPR-Cas systems of the present invention can be used to correct genetic mutations that were previously attempted with limited success using TALEN and ZFN and have been identified as potential targets for Cas9 systems, including as in published applications of Editas Medicine describing methods to use Cas9 systems to target loci to therapeutically address diseaes with gene therapy, including, WO 2015/048577 CRISPR-RELATED METHODS AND COMPOSITIONS of Gluckmann et al.; WO 2015/070083 CRISPR-RELATED METHODS AND COMPOSITIONS WITH GOVERNING gRNAS of Glucksmann et al.; In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference.

Mention is made of WO2015/134812 CRISPR/CAS-RELATED METHODS AND COMPOSITIONS FOR TREATING USHER SYNDROME AND RETINITIS PIGMENTOSA of Maeder et al. Through the teachings herein the invention comprehends methods and materials of these documents applied in conjunction with the teachings herein. In an aspect of ocular and auditory gene therapy, methods and compositions for treating Usher Syndrome and Retinis-Pigmentosa may be adapted to the CRISPR-Cas system of the present invention (see, e.g., WO 2015/134812). In an embodiment, the WO 2015/134812 involves a treatment or delaying the onset or progression of Usher Syndrome type IIA (USH2A, USH11A) and retinitis pigmentosa 39 (RP39) by gene editing, e.g., using CRISPR-Cas9 mediated methods to correct the guanine deletion at position 2299 in the USH2A gene (e.g., replace the deleted guanine residue at position 2299 in the USH2A gene).A similar effect can be achieved with Cas. In a related aspect, a mutation is targeted by cleaving with either one or more nuclease, one or more nickase, or a combination thereof, e.g., to induce HDR with a donor template that corrects the point mutation (e.g., the single nucleotide, e.g., guanine, deletion). The alteration or correction of the mutant USH2A gene can be mediated by any mechanism. Exemplary mechanisms that can be associated with the alteration (e.g., correction) of the mutant HSH2A gene include, but are not limited to, non-homologous end joining, microhomology-mediated end joining (MMEJ), homology-directed repair (e.g., endogenous donor template mediated), SDSA (synthesis dependent strand annealing), single-strand annealing or single strand invasion. In an embodiment, the method used for treating Usher Syndrome and Retinis-Pigmentosa can include acquiring knowledge of the mutation carried by the subject, e.g., by sequencing the appropriate portion of the USH2A gene.

Accordingly, in some embodiments, the treatment, prophylaxis or diagnosis of Retinitis Pigmentosa is provided. A number of different genes are known to be associated with or result in Retinitis Pigmentosa, such as RP1, RP2 and so forth. These genes are targeted in some embodiments and either knocked out or repaired through provision of suitable a template. In some embodiments, delivery is to the eye by injection.

One or more Retinitis Pigmentosa genes can, in some embodiments, be selected from: RP1 (Retinitis pigmentosa-1), RP2 (Retinitis pigmentosa-2), RPGR (Retinitis pigmentosa-3), PRPH2 (Retinitis pigmentosa-7), RP9 (Retinitis pigmentosa-9), IMPDH1 (Retinitis pigmentosa-10), PRPF31 (Retinitis pigmentosa-11), CRB1 (Retinitis pigmentosa-12, autosomal recessive), PRPF8 (Retinitis pigmentosa-13), TULP1 (Retinitis pigmentosa-14), CA4 (Retinitis pigmentosa-17), HPRPF3 (Retinitis pigmentosa-18), ABCA4 (Retinitis pigmentosa-19), EYS (Retinitis pigmentosa-25), CERKL (Retinitis pigmentosa-26), FSCN2 (Retinitis pigmentosa-30), TOPORS (Retinitis pigmentosa-31), SNRNP200 (Retinitis pigmentosa 33), SEMA4A (Retinitis pigmentosa-35), PRCD (Retinitis pigmentosa-36), NR2E3 (Retinitis pigmentosa-37), MERTK (Retinitis pigmentosa-38), USH2A (Retinitis pigmentosa-39), PROM1 (Retinitis pigmentosa-41), KLHL7 (Retinitis pigmentosa-42), CNGB1 (Retinitis pigmentosa-45), BEST1 (Retinitis pigmentosa-50), TTC8 (Retinitis pigmentosa 51), $C_2orf71$ (Retinitis pigmentosa 54), ARL6 (Retinitis pigmentosa 55), ZNF513 (Retinitis pigmentosa 58), DHDDS (Retinitis pigmentosa 59), BEST1 (Retinitis pigmentosa, concentric), PRPH2 (Retinitis pigmentosa, digenic), LRAT (Retinitis pigmentosa, juvenile), SPATA7 (Retinitis pigmentosa, juvenile, autosomal recessive), CRX (Retinitis pigmentosa, late-onset dominant), and/or RPGR (Retinitis pigmentosa, X-linked, and sinorespiratory infections, with or without deafness).

In some embodiments, the Retinitis Pigmentosa gene is MERTK (Retinitis pigmentosa-38) or USH2A (Retinitis pigmentosa-39).

Mention is also made of WO 2015/138510 and through the teachings herein the invention (using a CRISPR-Cas9 system) comprehends providing a treatment or delaying the onset or progression of Leber's Congenital Amaurosis 10 (LCA 10). LCA 10 is caused by a mutation in the CEP290 gene, e.g., a c.2991+1655, adenine to guanine mutation in the CEP290 gene which gives rise to a cryptic splice site in intron 26. This is a mutation at nucleotide 1655 of intron 26 of CEP290, e.g., an A to G mutation. CEP290 is also known as: CT87; MKS4; POC3; rdl6; BBS14; JBTS5; LCAJO; NPHP6; SLSN6; and 3H11Ag (see, e.g., WO 2015/138510). In an aspect of gene therapy, the invention involves introducing one or more breaks near the site of the LCA target position (e.g., c.2991+1655; A to G) in at least one allele of the CEP290 gene. Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+1655A to G). Both approaches give rise to the loss or destruction of the cryptic splice site resulting from the mutation at the LCA 10 target position. Accordingly, the use of Cas in the treatment of LCA is specifically envisaged.

Researchers are contemplating whether gene therapies could be employed to treat a wide range of diseases. The CRISPR systems of the present invention based on Cas effector protein are envisioned for such therapeutic uses, including, but noted limited to further exemplified targeted areas and with delivery methods as below. Some examples of conditions or diseases that might be usefully treated using the present system are included in the examples of genes and references included herein and are currently associated with those conditions are also provided there. The genes and conditions exemplified are not exhaustive.

Treating Diseases of the Circulatory System

The present invention also contemplates delivering the CRISPR-Cas system, specifically the novel CRISPR effector protein systems described herein, to the blood or hematopoetic stem cells. The plasma exosomes of Wahlgren et al. (Nucleic Acids Research, 2012, Vol. 40, No. 17 e130) were previously described and may be utilized to deliver the CRISPR Cas system to the blood. The nucleic acid-targeting system of the present invention is also contemplated to treat hemoglobinopathies, such as thalassemias and sickle cell disease. See, e.g., International Patent Publication No. WO 2013/126794 for potential targets that may be targeted by the CRISPR Cas system of the present invention.

Drakopoulou, "Review Article, The Ongoing Challenge of Hematopoietic Stem Cell-Based Gene Therapy for β-Thalassemia," Stem Cells International, Volume 2011, Article ID 987980, 10 pages, doi:10.4061/2011/987980, incorporated herein by reference along with the documents it cites, as if set out in full, discuss modifying HSCs using a lentivirus that delivers a gene for β-globin or γ-globin. In contrast to using lentivirus, with the knowledge in the art and the teachings in this disclosure, the skilled person can correct HSCs as to β-Thalassemia using a CRISPR-Cas system that targets and corrects the mutation (e.g., with a suitable HDR template that delivers a coding sequence for β-globin or γ-globin, advantageously non-sickling β-globin or γ-globin); specifically, the guide RNA can target mutation that give rise to β-Thalassemia, and the HDR can provide coding for proper expression of β-globin or γ-globin. An guide RNA that targets the mutation-and-Cas protein containing particle is contacted with HSCs carrying the mutation. The particle also can contain a suitable HDR template to correct the mutation for proper expression of β-globin or γ-globin; or the HSC can be contacted with a second particle or a vector that contains or delivers the HDR template. The so contacted cells can be administered; and optionally treated/expanded; cf. Cartier. In this regard mention is made of: Cavazzana, "Outcomes of Gene Therapy for β-Thalassemia Major via Transplantation of Autologous Hematopoietic Stem Cells Transduced Ex Vivo with a Lentiviral PA-T87Q-Globin Vector." tif2014.org/abstractFiles/Jean %20Antoine %20Ribeil_Abstract.pdf; Cavazzana-Calvo, "Transfusion independence and HMGA2 activation after gene therapy of human 0-thalassaemia", Nature 467, 318-322 (16 Sep. 2010) doi:10.1038/nature09328; Nienhuis, "Development of Gene Therapy for Thalassemia, Cold Spring Harbor Perpsectives in Medicine, doi: 10.1101/cshperspect.a011833 (2012), LentiGlobin BB305, a lentiviral vector containing an engineered β-globin gene (PA-T87Q); and Xie et al., "Seamless gene correction of 0-thalassaemia mutations in patient-specific iPSCs using CRISPR/Cas9 and piggyback" Genome Research gr.173427.114 (2014) www.genome.org/cgi/doi/10.1101/gr.173427.114 (Cold Spring Harbor Laboratory Press); that is the subject of Cavazzana work involving human 0-thalassaemia and the subject of the Xie work, are all incorporated herein by reference, together with all documents cited therein or associated therewith. In the instant invention, the HDR template can provide for the HSC to express an engineered β-globin gene (e.g., PA-T87Q), or β-globin as in Xie.

Xu et al. (Sci Rep. 2015 Jul. 9; 5:12065. doi: 10.1038/srep12065) have designed TALENs and CRISPR-Cas9 to directly target the intron2 mutation site IVS2-654 in the globin gene. Xu et al. observed different frequencies of double-strand breaks (DSBs) at IVS2-654 loci using TALENs and CRISPR-Cas9, and TALENs mediated a higher homologous gene targeting efficiency compared to CRISPR-Cas9 when combined with the piggyBac transposon donor. In addition, more obvious off-target events were observed for CRISPR-Cas9 compared to TALENs. Finally, TALENs-corrected iPSC clones were selected for erythroblast differentiation using the OP9 co-culture system and detected relatively higher transcription of HBB than the uncorrected cells.

Song et al. (Stem Cells Dev. 2015 May 1;24(9):1053-65. doi: 10.1089/scd.2014.0347. Epub 2015 Feb. 5) used CRISPR/Cas9 to correct 3-Thal iPSCs; gene-corrected cells exhibit normal karyotypes and full pluripotency as human embryonic stem cells (hESCs) showed no off-targeting effects. Then, Song et al. evaluated the differentiation efficiency of the gene-corrected β-Thal iPSCs. Song et al. found that during hematopoietic differentiation, gene-corrected β-Thal iPSCs showed an increased embryoid body ratio and various hematopoietic progenitor cell percentages. More importantly, the gene-corrected β-Thal iPSC lines restored HBB expression and reduced reactive oxygen species production compared with the uncorrected group. Song et al.'s study suggested that hematopoietic differentiation efficiency of 3-Thal iPSCs was greatly improved once corrected by the CRISPR-Cas9 system. Similar methods may be performed utilizing the CRISPR-Cas systems described herein, e.g. systems comprising Cas effector proteins.

Sickle cell anemia is an autosomal recessive genetic disease in which red blood cells become sickle-shaped. It is caused by a single base substitution in the β-globin gene, which is located on the short arm of chromosome 11. As a result, valine is produced instead of glutamic acid causing the production of sickle hemoglobin (HbS). This results in the formation of a distorted shape of the erythrocytes. Due to this abnormal shape, small blood vessels can be blocked, causing serious damage to the bone, spleen and skin tissues. This may lead to episodes of pain, frequent infections, hand-foot syndrome or even multiple organ failure. The distorted erythrocytes are also more susceptible to hemolysis, which leads to serious anemia. As in the case of 0-thalassaemia, sickle cell anemia can be corrected by modifying HSCs with the CRISPR-Cas system. The system allows the specific editing of the cell's genome by cutting its DNA and then letting it repair itself. The Cas protein is inserted and directed by an RNA guide to the mutated point and then it cuts the DNA at that point. Simultaneously, a healthy version of the sequence is inserted. This sequence is used by the cell's own repair system to fix the induced cut. In this way, the CRISPR-Cas allows the correction of the mutation in the previously obtained stem cells. With the knowledge in the art and the teachings in this disclosure, the skilled person can correct HSCs as to sickle cell anemia using a CRISPR-Cas system that targets and corrects the mutation (e.g., with a suitable HDR template that delivers a coding sequence for β-globin, advantageously non-sickling β-globin); specifically, the guide RNA can target mutation that give rise to sickle cell anemia, and the HDR can provide coding for proper expression of β-globin. An guide RNA that targets the mutation-and-Cas protein containing particle is contacted with HSCs carrying the mutation. The particle also can contain a suitable HDR template to correct the mutation for proper expression of β-globin; or the HSC can be contacted with a second particle or a vector that contains or delivers the HDR template. The so contacted cells can be administered; and optionally treated/expanded; cf. Cartier. The HDR template can provide for the HSC to express an engineered β-globin gene (e.g., PA-T87Q), or β-globin as in Xie.

Williams, "Broadening the Indications for Hematopoietic Stem Cell Genetic Therapies," Cell Stem Cell 13:263-264 (2013), incorporated herein by reference along with the documents it cites, as if set out in full, report lentivirus-mediated gene transfer into HSC/P cells from patients with the lysosomal storage disease metachromatic leukodystrophy disease (MLD), a genetic disease caused by deficiency of arylsulfatase A (ARSA), resulting in nerve demyelination; and lentivirus-mediated gene transfer into HSCs of patients with Wiskott-Aldrich syndrome (WAS) (patients with defective WAS protein, an effector of the small GTPase CDC42 that regulates cytoskeletal function in blood cell lineages and thus suffer from immune deficiency with recurrent infections, autoimmune symptoms, and thrombocytopenia with abnormally small and dysfunctional platelets leading to excessive bleeding and an increased risk of leukemia and lymphoma). In contrast to using lentivirus, with the knowledge in the art and the teachings in this disclosure, the skilled person can correct HSCs as to MLD (deficiency of arylsulfatase A (ARSA)) using a CRISPR-Cas system that targets and corrects the mutation (deficiency of arylsulfatase A (ARSA)) (e.g., with a suitable HDR template that delivers a coding sequence for ARSA); specifically, the guide RNA can target mutation that gives rise to MLD (deficient ARSA), and the HDR can provide coding for proper expression of ARSA. An guide RNA that targets the mutation-and-Cas protein containing particle is contacted with HSCs carrying the mutation. The particle also can contain a suitable HDR template to correct the mutation for proper expression of ARSA; or the HSC can be contacted with a second particle or a vector that contains or delivers the HDR template. The so contacted cells can be administered; and optionally treated/expanded; cf. Cartier. In contrast to using lentivirus, with the knowledge in the art and the teachings in this disclosure, the skilled person can correct HSCs as to WAS using a CRISPR-Cas system that targets and corrects the mutation (deficiency of WAS protein) (e.g., with a suitable HDR template that delivers a coding sequence for WAS protein); specifically, the guide RNA can target mutation that gives rise to WAS (deficient WAS protein), and the HDR can provide coding for proper expression of WAS protein. A guide RNA that targets the mutation-and-Cas protein containing particle is contacted with HSCs carrying the mutation. The particle also can contain a suitable HDR template to correct the mutation for proper expression of WAS protein; or the HSC can be contacted with a second particle or a vector that contains or delivers the HDR template. The so contacted cells can be administered; and optionally treated/expanded; cf. Cartier.

Watts, "Hematopoietic Stem Cell Expansion and Gene Therapy" Cytotherapy 13(10):1164-1171. doi:10.3109/14653249.2011.620748 (2011), incorporated herein by reference along with the documents it cites, as if set out in full, discusses hematopoietic stem cell (HSC) gene therapy, e.g., virus-mediated HSC gene therapy, as an highly attractive treatment option for many disorders including hematologic conditions, immunodeficiencies including HIV/AIDS, and other genetic disorders like lysosomal storage diseases, including SCID-X1, ADA-SCID, 0-thalassemia, X-linked CGD, Wiskott-Aldrich syndrome, Fanconi anemia, adrenoleukodystrophy (ALD), and metachromatic leukodystrophy (MLD).

US Patent Publication Nos. 20110225664, 20110091441, 20100229252, 20090271881 and 20090222937 assigned to Cellectis, relates to CREI variants, wherein at least one of the two I-CreI monomers has at least two substitutions, one in each of the two functional subdomains of the LAGLIDADG (SEQ ID NO: 218) core domain situated respectively from positions 26 to 40 and 44 to 77 of I-CreI, said variant being able to cleave a DNA target sequence from the human interleukin-2 receptor gamma chain (IL2RG) gene also named common cytokine receptor gamma chain gene or gamma C gene. The target sequences identified in US Patent Publication Nos. 20110225664, 20110091441, 20100229252, 20090271881 and 20090222937 may be utilized for the nucleic acid-targeting system of the present invention.

Severe Combined Immune Deficiency (SCID) results from a defect in lymphocytes T maturation, always associated with a functional defect in lymphocytes B (Cavazzana-Calvo et al., Annu. Rev. Med., 2005, 56, 585-602; Fischer et al., Immunol. Rev., 2005, 203, 98-109). Overall incidence is estimated to 1 in 75 000 births. Patients with untreated SCID are subject to multiple opportunist micro-organism infections, and do generally not live beyond one year. SCID can be treated by allogenic hematopoietic stem cell transfer, from a familial donor. Histocompatibility with the donor can vary widely. In the case of Adenosine Deaminase (ADA) deficiency, one of the SCID forms, patients can be treated by injection of recombinant Adenosine Deaminase enzyme.

Since the ADA gene has been shown to be mutated in SCID patients (Giblett et al., Lancet, 1972, 2, 1067-1069), several other genes involved in SCID have been identified (Cavazzana-Calvo et al., Annu. Rev. Med., 2005, 56, 585-602; Fischer et al., Immunol. Rev., 2005, 203, 98-109). There are four major causes for SCID: (i) the most frequent form of SCID, SCID-X1 (X-linked SCID or X-SCID), is caused by mutation in the IL2RG gene, resulting in the absence of mature T lymphocytes and NK cells. IL2RG encodes the gamma C protein (Noguchi, et al., Cell, 1993, 73, 147-157), a common component of at least five interleukin receptor complexes. These receptors activate several targets through the JAK3 kinase (Macchi et al., Nature, 1995, 377, 65-68), which inactivation results in the same syndrome as gamma C inactivation; (ii) mutation in the ADA gene results in a defect in purine metabolism that is lethal for lymphocyte precursors, which in turn results in the quasi absence of B, T and NK cells; (iii) V(D)J recombination is an essential step in the maturation of immunoglobulins and T lymphocytes receptors (TCRs). Mutations in Recombination Activating Gene 1 and 2 (RAG1 and RAG2) and Artemis, three genes involved in this process, result in the absence of mature T and B lymphocytes; and (iv) Mutations in other genes such as CD45, involved in T cell specific signaling have also been reported, although they represent a minority of cases (Cavazzana-Calvo et al., Annu. Rev. Med., 2005, 56, 585-602; Fischer et al., Immunol. Rev., 2005, 203, 98-109). Since when their genetic bases have been identified, the different SCID forms have become a paradigm for gene therapy approaches (Fischer et al., Immunol. Rev., 2005, 203, 98-109) for two major reasons. First, as in all blood diseases, an ex vivo treatment can be envisioned. Hematopoietic Stem Cells (HSCs) can be recovered from bone marrow, and keep their pluripotent properties for a few cell divisions. Therefore, they can be treated in vitro, and then reinjected into the patient, where they repopulate the bone marrow. Second, since the maturation of lymphocytes is impaired in SCID patients, corrected cells have a selective advantage. Therefore, a small number of corrected cells can restore a functional immune system. This hypothesis was validated several times by (i) the partial restoration of immune functions associated with the reversion of mutations in SCID patients (Hirschhorn et al., Nat. Genet., 1996, 13, 290-295; Stephan et al., N. Engl. J. Med., 1996, 335, 1563-1567; Bousso et al., Proc. Natl., Acad. Sci. USA, 2000, 97, 274-278; Wada et al., Proc. Natl. Acad. Sci. USA, 2001, 98, 8697-8702; Nishikomori et al., Blood, 2004, 103, 4565-4572), (ii) the correction of SCID-X1 deficiencies in vitro in hematopoietic cells (Candotti et al., Blood, 1996, 87, 3097-3102; Cavazzana-Calvo et al., Blood, 1996, Blood, 88, 3901-3909; Taylor et al., Blood, 1996, 87, 3103-3107; Hacein-Bey et al., Blood, 1998, 92, 4090-4097), (iii) the correction of SCID-X1 (Soudais et al., Blood, 2000, 95, 3071-3077; Tsai et al., Blood, 2002, 100, 72-79), JAK-3 (Bunting et al., Nat. Med., 1998, 4, 58-64; Bunting et al., Hum. Gene Ther., 2000, 11, 2353-2364) and RAG2 (Yates et al., Blood, 2002, 100, 3942-3949) deficiencies in vivo in animal models and (iv) by the result of gene therapy clinical trials (Cavazzana-Calvo et al., Science, 2000, 288, 669-672; Aiuti et al., Nat. Med., 2002; 8, 423-425; Gaspar et al., Lancet, 2004, 364, 2181-2187).

US Patent Publication No. 20110182867 assigned to the Children's Medical Center Corporation and the President and Fellows of Harvard College relates to methods and uses of modulating fetal hemoglobin expression (HbF) in hematopoietic progenitor cells via inhibitors of BCL11A expression or activity, such as RNAi and antibodies. The targets disclosed in US Patent Publication No. 20110182867, such as BCL11A, may be targeted by the CRISPR Cas system of the present invention for modulating fetal hemoglobin expression. See also Bauer et al. (Science 11 Oct. 2013: Vol. 342 no. 6155 pp. 253-257) and Xu et al. (Science 18 Nov. 2011: Vol. 334 no. 6058 pp. 993-996) for additional BCL11A targets.

With the knowledge in the art and the teachings in this disclosure, the skilled person can correct HSCs as to a genetic hematologic disorder, e.g., β-Thalassemia, Hemophilia, or a genetic lysosomal storage disease.

HSC—Delivery to and Editing of Hematopoietic Stem Cells; and Particular Conditions.

The term "Hematopoetic Stem Cell" or "HSC" is meant to include broadly those cells considered to be an HSC, e.g., blood cells that give rise to all the other blood cells and are derived from mesoderm; located in the red bone marrow, which is contained in the core of most bones. HSCs of the invention include cells having a phenotype of hematopoeitic stem cells, identified by small size, lack of lineage (lin) markers, and markers that belong to the cluster of differentiation series, like: CD34, CD38, CD90, CD133, CD105, CD45, and also c-kit,—the receptor for stem cell factor. Hematopoietic stem cells are negative for the markers that are used for detection of lineage commitment, and are, thus, called Lin-; and, during their purification by FACS, a number of up to 14 different mature blood-lineage markers, e.g., CD13 & CD33 for myeloid, CD71 for erythroid, CD19 for B cells, CD61 for megakaryocytic, etc. for humans; and, B220 (murine CD45) for B cells, Mac-1 (CD11b/CD18) for monocytes, Gr-1 for Granulocytes, Ter 19 for erythroid cells, Il7Ra, CD3, CD4, CD5, CD8 for T cells, etc. Mouse HSC markers: CD34lo/-, SCA-1+, Thy1.1+/lo, CD38+, C-kit+, lin-, and Human HSC markers: CD34+, CD59+, Thy1/CD90+, CD38lo/-, C-kit/CD117+, and lin-. HSCs are identified by markers. Hence in embodiments discussed herein, the HSCs can be CD34+ cells. HSCs can also be hematopoietic stem cells that are CD34-/CD38-. Stem cells that may lack c-kit on the cell surface that are considered in the art as HSCs are within the ambit of the invention, as well as CD133+ cells likewise considered HSCs in the art.

The CRISPR-Cas (eg Cpf1) system may be engineered to target genetic locus or loci in HSCs. Cas (eg Cpf1) protein, advantageously codon-optimized for a eukaryotic cell and especially a mammalian cell, e.g., a human cell, for instance, HSC, and sgRNA targeting a locus or loci in HSC, e.g., the gene EMX1, may be prepared. These may be delivered via particles. The particles may be formed by the Cas (eg Cpf1) protein and the gRNA being admixed. The gRNA and Cas (eg Cpf1) protein mixture may for example be admixed with a mixture comprising or consisting essentially of or consisting of surfactant, phospholipid, biodegradable polymer, lipoprotein and alcohol, whereby particles containing the gRNA and Cas (eg Cpf1) protein may be formed. The invention comprehends so making particles and particles from such a method as well as uses thereof.

More generally, particles may be formed using an efficient process. First, Cas (eg Cpf1) protein and gRNA targeting the gene EMX1 or the control gene LacZ may be mixed together at a suitable, e.g.,3:1 to 1:3 or 2:1 to 1:2 or 1:1 molar ratio, at a suitable temperature, e.g., 15-30C, e.g., 20-25C, e.g., room temperature, for a suitable time, e.g., 15-45, such as 30 minutes, advantageously in sterile, nuclease free buffer, e.g., 1× PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol may be dissolved in an alcohol, advantageously a $C_1$-6 alkyl alcohol, such as methanol, ethanol, isopropanol, e.g., 100% ethanol. The two solutions may be mixed together to form particles containing the Cas (eg Cpf1)-gRNA complexes. In certain embodiments the particle can contain an HDR template. That can be a particle co-administered with gRNA+Cas (eg Cpf1) protein-containing particle, or i.e., in addition to contacting an HSC with an gRNA+Cas (eg Cpf1) protein-containing particle, the HSC is contacted with a particle containing an HDR template; or the HSC is contacted with a particle containing all of the gRNA, Cas (eg Cpf1) and the HDR template. The HDR template can be administered by a separate vector, whereby in a first instance the particle penetrates an HSC cell and the separate vector also penetrates the cell, wherein the HSC genome is modified by the gRNA+Cas (eg Cpf1) and the HDR template is also present, whereby a genomic loci is modified by the HDR; for instance, this may result in correcting a mutation.

After the particles form, HSCs in 96 well plates may be transfected with 15ug Cas (eg Cpf1) protein per well. Three days after transfection, HSCs may be harvested, and the number of insertions and deletions (indels) at the EMX1 locus may be quantified.

This illustrates how HSCs can be modified using CRISPR-Cas (eg Cpf1) targeting a genomic locus or loci of interest in the HSC. The HSCs that are to be modified can be in vivo, i.e., in an organism, for example a human or a non-human eukaryote, e.g., animal, such as fish, e.g., zebra fish, mammal, e.g., primate, e.g., ape, chimpanzee, macaque, rodent, e.g., mouse, rabbit, rat, canine or dog, livestock (cow/bovine, sheep/ovine, goat or pig), fowl or poultry, e.g., chicken. The HSCs that are to be modified can be in vitro, i.e., outside of such an organism. And, modified HSCs can be used ex vivo, i.e., one or more HSCs of such an organism can be obtained or isolated from the organism, optionally the HSC(s) can be expanded, the HSC(s) are modified by a composition comprising a CRISPR-Cas (eg Cpf1) that targets a genetic locus or loci in the HSC, e.g., by contacting the HSC(s) with the composition, for instance, wherein the composition comprises a particle containing the CRISPR enzyme and one or more gRNA that targets the genetic locus or loci in the HSC, such as a particle obtained or obtainable from admixing an gRNA and Cas (e.g., Cpf1) protein mixture with a mixture comprising or consisting essentially of or consisting of surfactant, phospholipid, biodegradable polymer, lipoprotein and alcohol (wherein one or more gRNA targets the genetic locus or loci in the HSC), optionally expanding the resultant modified HSCs and administering to the organism the resultant modified HSCs. In some instances, the isolated or obtained HSCs can be from a first organism, such as an organism from a same species as a second organism, and the second organism can be the organism to which the the resultant modified HSCs are administered, e.g., the first organism can be a donor (such as a relative as in a parent or sibling) to the second organism. Modified HSCs can have genetic modifications to address or alleviate or reduce symptoms of a disease or condition state of an individual or subject or patient. Modified HSCs, e.g., in the instance of a first organism donor to a second organism, can have genetic modifications to have the HSCs have one or more proteins e.g. surface markers or proteins more like that of the second organism. Modified HSCs can have genetic modifications to simulate a a disease or condition state of an individual or subject or patient and would be re-administered to a non-human organism so as to prepare an animal model. Expansion of HSCs is within the ambit of the skilled person from this disclosure and knowledge in the art, see e.g., Lee, "Improved ex vivo expansion of adult hematopoietic stem cells by overcoming CUL4-mediated degradation of HOXB4." Blood. 2013 May 16;121(20): 4082-9. doi: 10.1182/blood-2012-09-455204. Epub 2013 Mar. 21.

As indicated to improve activity, gRNA may be pre-complexed with the Cas (e.g., Cpf1) protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP: DMPC: PEG: Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. The invention accordingly comprehends admixing gRNA, Cas (eg Cpf1) protein and components that form a particle; as well as particles from such admixing.

In a preferred embodiment, particles containing the Cas (eg Cpf1)-gRNA complexes may be formed by mixing Cas (eg Cpf1) protein and one or more gRNAs together, preferably at a 1:1 molar ratio, enzyme: guide RNA. Separately, the different components known to promote delivery of nucleic acids (e.g. DOTAP, DMPC, PEG, and cholesterol) are dissolved, preferably in ethanol. The two solutions are mixed together to form particles containing the Cas (eg Cpf1)-gRNA complexes. After the particles are formed, Cas (e.g., Cpf1)-gRNA complexes may be transfected into cells (e.g. HSCs). Bar coding may be applied. The particles, the Cas-9 and/or the gRNA may be barcoded.

The invention in an embodiment comprehends a method of preparing an gRNA-and-Cas (eg Cpf1) protein containing particle comprising admixing an gRNA and Cas (eg Cpf1) protein mixture with a mixture comprising or consisting essentially of or consisting of surfactant, phospholipid, biodegradable polymer, lipoprotein and alcohol. An embodiment comprehends an gRNA-and-Cas (eg Cpf1) protein containing particle from the method. The invention in an embodiment comprehends use of the particle in a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest; or a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest. In these embodiments, the genomic locus of interest is advantageously a genomic locus in an HSC.

Considerations for Therapeutic Applications: A consideration in genome editing therapy is the choice of sequence-specific nuclease, such as a variant of a Cas nuclease. Each nuclease variant may possess its own unique set of strengths and weaknesses, many of which must be balanced in the context of treatment to maximize therapeutic benefit. Thus far, two therapeutic editing approaches with nucleases have shown significant promise: gene disruption and gene correction. Gene disruption involves stimulation of NHEJ to create targeted indels in genetic elements, often resulting in loss of function mutations that are beneficial to patients. In contrast, gene correction uses HDR to directly reverse a disease causing mutation, restoring function while preserving physiological regulation of the corrected element. HDR may also be used to insert a therapeutic transgene into a defined 'safe harbor' locus in the genome to recover missing gene function. For a specific editing therapy to be efficacious, a sufficiently high level of modification must be achieved in target cell populations to reverse disease symptoms. This therapeutic modification 'threshold' is determined by the fitness of edited cells following treatment and the amount of gene product necessary to reverse symptoms. With regard to fitness, editing creates three potential outcomes for treated cells relative to their unedited counterparts: increased, neutral, or decreased fitness. In the case of increased fitness, for example in the treatment of SCID-X1, modified hematopoietic progenitor cells selectively expand relative to their unedited counterparts. SCID-X1 is a disease caused by mutations in the IL2RG gene, the function of which is required for proper development of the hematopoietic lymphocyte lineage [Leonard, W. J., et al. Immunological reviews 138, 61-86 (1994); Kaushansky, K. & Williams, W. J. Williams hematology, (McGraw-Hill Medical, New York, 2010)]. In clinical trials with patients who received viral gene therapy for SCID-X1, and a rare example of a spontaneous correction of SCID-X1 mutation, corrected hematopoietic progenitor cells may be able to overcome this developmental block and expand relative to their diseased counterparts to mediate therapy [Bousso, P., et al. Proceedings of the National Academy of Sciences of the United States of America 97, 274-278 (2000); Hacein-Bey-Abina, S., et al. The New England journal of medicine 346, 1185-1193 (2002); Gaspar, H. B., et al. Lancet 364, 2181-2187 (2004)]. In this case, where edited cells possess a selective advantage, even low numbers of edited cells can be amplified through expansion, providing a therapeutic benefit to the patient. In contrast, editing for other hematopoietic diseases, like chronic granulomatous disorder (CGD), would induce no change in fitness for edited hematopoietic progenitor cells, increasing the therapeutic modification threshold. CGD is caused by mutations in genes encoding phagocytic oxidase proteins, which are normally used by neutrophils to generate reactive oxygen species that kill pathogens [Mukherjee, S. & Thrasher, A. J. Gene 525, 174-181 (2013)]. As dysfunction of these genes does not influence hematopoietic progenitor cell fitness or development, but only the ability of a mature hematopoietic cell type to fight infections, there would be likely no preferential expansion of edited cells in this disease. Indeed, no selective advantage for gene corrected cells in CGD has been observed in gene therapy trials, leading to difficulties with long-term cell engraftment [Malech, H. L., et al. Proceedings of the National Academy of Sciences of the United States of America 94, 12133-12138 (1997); Kang, H. J., et al. Molecular therapy: the journal of the American Society of Gene Therapy 19, 2092-2101 (2011)]. As such, significantly higher levels of editing would be required to treat diseases like CGD, where editing creates a neutral fitness advantage, relative to diseases where editing creates increased fitness for target cells. If editing imposes a fitness disadvantage, as would be the case for restoring function to a tumor suppressor gene in cancer cells, modified cells would be outcompeted by their diseased counterparts, causing the benefit of treatment to be low relative to editing rates. This latter class of diseases would be particularly difficult to treat with genome editing therapy.

In addition to cell fitness, the amount of gene product necessary to treat disease also influences the minimal level of therapeutic genome editing that must be achieved to reverse symptoms. Hemophilia B is one disease where a small change in gene product levels can result in significant changes in clinical outcomes. This disease is caused by mutations in the gene encoding factor IX, a protein normally secreted by the liver into the blood, where it functions as a component of the clotting cascade. Clinical severity of hemophilia B is related to the amount of factor IX activity. Whereas severe disease is associated with less than 1% of normal activity, milder forms of the diseases are associated with greater than 1% of factor IX activity [Kaushansky, K. & Williams, W. J. Williams hematology, (McGraw-Hill Medical, New York, 2010); Lofqvist, T., et al. Journal of internal medicine 241, 395-400 (1997)]. This suggests that editing therapies that can restore factor IX expression to even a small percentage of liver cells could have a large impact on clinical outcomes. A study using ZFNs to correct a mouse model of hemophilia B shortly after birth demonstrated that 3-7% correction was sufficient to reverse disease symptoms, providing preclinical evidence for this hypothesis [$L^1$, H., et al. Nature 475, 217-221 (2011)].

Disorders where a small change in gene product levels can influence clinical outcomes and diseases where there is a fitness advantage for edited cells, are ideal targets for genome editing therapy, as the therapeutic modification threshold is low enough to permit a high chance of success given the current technology. Targeting these diseases has now resulted in successes with editing therapy at the preclinical level and a phase I clinical trial. Improvements in DSB repair pathway manipulation and nuclease delivery are needed to extend these promising results to diseases with a neutral fitness advantage for edited cells, or where larger amounts of gene product are needed for treatment. Table 18 below shows some examples of applications of genome editing to therapeutic models, and the references of the below Table and the documents cited in those references are hereby incorporated herein by reference as if set out in full.

TABLE 18

| Disease Type | Nuclease Platform Employed | Therapeutic Strategy | References |
|---|---|---|---|
| Hemophilia B | ZFN | HDR-mediated insertion of correct gene sequence | Li, H., et al. Nature 475, 217-221 (2011) |
| SCID | ZFN | HDR-mediated insertion of correct gene sequence | Genovese, P., et al. Nature 510, 235-240 (2014) |
| Hereditary tyrosinemia | CRISPR | HDR-mediated correction of mutation in liver | Yin, H., et al. Nature biotechnology 32, 551-553 (2014) |

Addressing each of the conditions of the foregoing table, using the CRISPR-Cas (eg Cpf1) system to target by either HDR-mediated correction of mutation, or HDR-mediated insertion of correct gene sequence, advantageously via a delivery system as herein, e.g., a particle delivery system, is within the ambit of the skilled person from this disclosure and the knowledge in the art. Thus, an embodiment comprehends contacting a Hemophilia B, SCID (e.g., SCID-X1, ADA-SCID) or Hereditary tyrosinemia mutation-carrying HSC with an gRNA-and-Cas (eg Cpf1) protein containing particle targeting a genomic locus of interest as to Hemophilia B, SCID (e.g., SCID-X1, ADA-SCID) or Hereditary tyrosinemia (e.g., as in $L^1$, Genovese or Yin). The particle also can contain a suitable HDR template to correct the mutation; or the HSC can be contacted with a second particle or a vector that contains or delivers the HDR template. In this regard, it is mentioned that Hemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications. With the knowledge in the art and the teachings in this disclosure, the skilled person can correct HSCs as to Hemophilia B using a CRISPR-Cas (eg Cpf1) system that targets and corrects the mutation (X-linked recessive disorder caused by loss-of-function mutations in the gene encoding Factor IX) (e.g., with a suitable HDR template that delivers a coding sequence for Factor IX); specifically, the gRNA can target mutation that give rise to Hemophilia B, and the HDR can provide coding for proper expression of Factor IX. An gRNA that targets the mutation-and-Cas (eg Cpf1) protein containing particle is contacted with HSCs carrying the mutation. The particle also can contain a suitable HDR template to correct the mutation for proper expression of Factor IX; or the HSC can be contacted with a second particle or a vector that contains or delivers the HDR template. The so contacted cells can be administered; and optionally treated/expanded; cf. Cartier, discussed herein.

In Cartier, "MINI-SYMPOSIUM: X-Linked Adrenoleukodystrophypa, Hematopoietic Stem Cell Transplantation and Hematopoietic Stem Cell Gene Therapy in X-Linked Adrenoleukodystrophy," Brain Pathology 20 (2010) 857-862, incorporated herein by reference along with the documents it cites, as if set out in full, there is recognition that allogeneic hematopoietic stem cell transplantation (HSCT) was utilized to deliver normal lysosomal enzyme to the brain of a patient with Hurler's disease, and a discussion of HSC gene therapy to treat ALD. In two patients, peripheral CD34+ cells were collected after granulocyte-colony stimulating factor (G-CSF) mobilization and transduced with an myeloproliferative sarcoma virus enhancer, negative control region deleted, dl587rev primer binding site substituted (MND)-ALD lentiviral vector. CD34+ cells from the patients were transduced with the MND-ALD vector during 16 h in the presence of cytokines at low concentrations. Transduced CD34+ cells were frozen after transduction to perform on 5% of cells various safety tests that included in particular three replication-competent lentivirus (RCL) assays. Transduction efficacy of CD34+ cells ranged from 35% to 50% with a mean number of lentiviral integrated copy between 0.65 and 0.70. After the thawing of transduced CD34+ cells, the patients were reinfused with more than 4.106 transduced CD34+ cells/kg following full myeloablation with busulfan and cyclophos-phamide. The patient's HSCs were ablated to favor engraftment of the gene-corrected HSCs. Hematological recovery occurred between days 13 and 15 for the two patients. Nearly complete immunological recovery occurred at 12 months for the first patient, and at 9 months for the second patient. In contrast to using lentivirus, with the knowledge in the art and the teachings in this disclosure, the skilled person can correct HSCs as to ALD using a CRISPR-Cas system that targets and corrects the mutation (e.g., with a suitable HDR template); specifically, the gRNA can target mutations in ABCD1, a gene located on the X chromosome that codes for ALD, a peroxisomal membrane transporter protein, and the HDR can provide coding for proper expression of the protein. An gRNA that targets the mutation-and-Cas protein containing particle is contacted with HSCs, e.g., CD34+ cells carrying the mutation as in Cartier. The particle also can contain a suitable HDR template to correct the mutation for expression of the peroxisomal membrane transporter protein; or the HSC can be contacted with a second particle or a vector that contains or delivers the HDR template. The so contacted cells optionally can be treated as in Cartier. The so contacted cells can be administered as in Cartier.

Mention is made of WO 2015/148860, through the teachings herein the invention comprehends methods and materials of these documents applied in conjunction with the teachings herein. In an aspect of blood-related disease gene therapy, methods and compositions for treating beta thalassemia may be adapted to the CRISPR-Cas system of the present invention (see, e.g., WO 2015/148860). In an embodiment, WO 2015/148860 involves the treatment or prevention of beta thalassemia, or its symptoms, e.g., by altering the gene for B-cell CLL/lymphoma 11A (BCL11A). The BCL11A gene is also known as B-cell CLL/lymphoma 11A, BCL11A -L, BCL11A -S, BCL11AXL, CTIP 1, HBFQTL5 and ZNF. BCL11A encodes a zinc-finger protein that is involved in the regulation of globin gene expression. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating beta thalassemia disease phenotypes.

Mention is also made of WO 2015/148863 and through the teachings herein the invention comprehends methods and materials of these documents which may be adapted to the CRISPR-Cas system of the present invention. In an aspect of treating and preventing sickle cell disease, which is an inherited hematologic disease, WO 2015/148863 comprehends altering the BCL11A gene. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating sickle cell disease phenotypes.

In an aspect of the invention, methods and compositions which involve editing a target nucleic acid sequence, or modulating expression of a target nucleic acid sequence, and applications thereof in connection with cancer immunotherapy are comprehended by adapting the CRISPR-Cas system of the present invention. Reference is made to the application of gene therapy in WO 2015/161276 which involves methods and compositions which can be used to affect T-cell proliferation, survival and/or function by altering one or more T-cell expressed genes, e.g., one or more of FAS, BID, CTLA4, PDCD1, CBLB, PTPN6, TRAC and/or TRBC genes. In a related aspect, T-cell proliferation can be affected by altering one or more T-cell expressed genes, e.g., the CBLB and/or PTPN6 gene, FAS and/or BID gene, CTLA4 and/or PDCD1 and/or TRAC and/or TRBC gene.

Chimeric antigen receptor (CAR)19 T-cells exhibit anti-leukemic effects in patient malignancies. However, leukemia patients often do not have enough T-cells to collect, meaning that treatment must involve modified T cells from donors. Accordingly, there is interest in establishing a bank of donor T-cells. Qasim et al. ("First Clinical Application of Talen Engineered Universal CAR19 T Cells in B-ALL" ASH 57th Annual Meeting and Exposition, Dec. 5-8, 2015, Abstract 2046 (ash.confex.com/ash/2015/webprogram/Paper81653.html published online November 2015) discusses modifying CAR19 T cells to eliminate the risk of graft-versus-host disease through the disruption of T-cell receptor expression and CD52 targeting. Furthermore, CD52 cells were targeted such that they became insensitive to Alemtuzumab, and thus allowed Alemtuzumab to prevent host-mediated rejection of human leukocyte antigen (HLA) mismatched CAR19 T-cells. Investigators used third generation self-inactivating lentiviral vector encoding a 4g7 CAR19 (CD19 scFv-4-1BB-CD3( ) linked to RQR8, then electroporated cells with two pairs of TALEN mRNA for multiplex targeting for both the T-cell receptor (TCR) alpha constant chain locus and the CD52 gene locus. Cells which were still expressing TCR following ex vivo expansion were depleted using CliniMacs a/P TCR depletion, yielding a T-cell product (UCART19) with <1% TCR expression, 85% of which expressed CAR19, and 64% becoming CD52 negative. The modified CAR19 T cells were administered to treat a patient's relapsed acute lymphoblastic leukemia. The teachings provided herein provide effective methods for providing modified hematopoietic stem cells and progeny thereof, including but not limited to cells of the myeloid and lymphoid lineages of blood, including T cells, B cells, monocytes, macrophages, neutrophils, basophils, eosinophils, erythrocytes, dendritic cells, and megakaryocytes or platelets, and natural killer cells and their precursors and progenitors. Such cells can be modified by knocking out, knocking in, or otherwise modulating targets, for example to remove or modulate CD52 as described above, and other targets, such as, without limitation, CXCR4, and PD-1. Thus compositions, cells, and method of the invention can be used to modulate immune responses and to treat, without limitation, malignancies, viral infections, and immune disorders, in conjunction with modification of administration of T cells or other cells to patients.

Mention is made of WO 2015/148670 and through the teachings herein the invention comprehends methods and materials of this document applied in conjunction with the teachings herein. In an aspect of gene therapy, methods and compositions for editing of a target sequence related to or in connection with Human Immunodeficiency Virus (HIV) and Acquired Immunodeficiency Syndrome (AIDS) are comprehended. In a related aspect, the invention described herein comprehends prevention and treatment of HIV infection and AIDS, by introducing one or more mutations in the gene for C-C chemokine receptor type 5 (CCR5). The CCR5 gene is also known as CKR5, CCR-5, CD195, CKR-5, CCCKR5, CMKBR5, IDDM22, and CC-CKR-5. In a further aspect, the invention described herein comprehends provide for prevention or reduction of HIV infection and/or prevention or reduction of the ability for HIV to enter host cells, e.g., in subjects who are already infected. Exemplary host cells for HIV include, but are not limited to, CD4 cells, T cells, gut associated lymphatic tissue (GALT), macrophages, dendritic cells, myeloid precursor cell, and microglia. Viral entry into the host cells requires interaction of the viral glycoproteins gp41 and gp120 with both the CD4 receptor and a co-receptor, e.g., CCR5. If a co-receptor, e.g., CCR5, is not present on the surface of the host cells, the virus cannot bind and enter the host cells. The progress of the disease is thus impeded. By knocking out or knocking down CCR5 in the host cells, e.g., by introducing a protective mutation (such as a CCR5 delta 32 mutation), entry of the HIV virus into the host cells is prevented.

X-linked Chronic granulomatous disease (CGD) is a hereditary disorder of host defense due to absent or decreased activity of phagocyte NADPH oxidase. Using a CRISPR-Cas system that targets and corrects the mutation (absent or decreased activity of phagocyte NADPH oxidase) (e.g., with a suitable HDR template that delivers a coding sequence for phagocyte NADPH oxidase); specifically, the gRNA can target mutation that gives rise to CGD (deficient phagocyte NADPH oxidase), and the HDR can provide coding for proper expression of phagocyte NADPH oxidase. An gRNA that targets the mutation-and-Cas protein containing particle is contacted with HSCs carrying the mutation. The particle also can contain a suitable HDR template to correct the mutation for proper expression of phagocyte NADPH oxidase; or the HSC can be contacted with a second particle or a vector that contains or delivers the HDR template. The so contacted cells can be administered; and optionally treated/expanded; cf. Cartier.

Fanconi anemia: Mutations in at least 15 genes (FANCA, FANCB, FANCC, FANCD1/BRCA2, FANCD2, FANCE, FANCF, FANCG, FANCI, FANCJ/BACH1/BRIP1, FANCL/PHF9/POG, FANCM, FANCN/PALB2, FANCO/Rad51C, and FANCP/SLX4/BTBD12) can cause Fanconi anemia. Proteins produced from these genes are involved in a cell process known as the FA pathway. The FA pathway is turned on (activated) when the process of making new copies of DNA, called DNA replication, is blocked due to DNA damage. The FA pathway sends certain proteins to the area of damage, which trigger DNA repair so DNA replication can continue. The FA pathway is particularly responsive to a certain type of DNA damage known as interstrand cross-links (ICLs). ICLs occur when two DNA building blocks (nucleotides) on opposite strands of DNA are abnormally attached or linked together, which stops the process of DNA replication. ICLs can be caused by a buildup of toxic substances produced in the body or by treatment with certain cancer therapy drugs. Eight proteins associated with Fanconi anemia group together to form a complex known as the FA core complex. The FA core complex activates two proteins, called FANCD2 and FANCI. The activation of these two proteins brings DNA repair proteins to the area of the ICL so the cross-link can be removed and DNA replication can continue. the FA core complex. More in particular, the FA core complex is a nuclear multiprotein complex consisting of FANCA, FANCB, FANCC, FANCE, FANCF, FANCG, FANCL, and FANCM, functions as an E3 ubiquitin ligase and mediates the activation of the ID complex, which is a heterodimer composed of FANCD2 and FANCI. Once monoubiquitinated, it interacts with classical tumor suppressors downstream of the FA pathway including FANCD1/BRCA2, FANCN/PALB2, FANCJ/BRIP1, and FANCO/Rad51C and thereby contributes to DNA repair via homologous recombination (HR). Eighty to 90 percent of FA cases are due to mutations in one of three genes, FANCA, FANCC, and FANCG. These genes provide instructions for producing components of the FA core complex. Mutations in such genes associated with the FA core complex will cause the complex to be nonfunctional and disrupt the entire FA pathway. As a result, DNA damage is not repaired efficiently and ICLs build up over time. Geiselhart, "Review Article, Disrupted Signaling through the Fanconi Anemia Pathway Leads to Dysfunctional Hematopoietic Stem Cell Biology: Underlying Mechanisms and Potential Therapeutic Strategies," Anemia Volume 2012 (2012), Article ID 265790, dx.doi.org/10.1155/2012/265790 discussed FA and an animal experiment involving intrafemoral injection of a lentivirus encoding the FANCC gene resulting in correction of HSCs in vivo. Using a CRISPR-Cas system that targets and one or more of the mutations associated with FA, for instance a CRISPR-Cas system having gRNA(s) and HDR template(s) that respectively targets one or more of the mutations of FANCA, FANCC, or FANCG that give rise to FA and provide corrective expression of one or more of FANCA, FANCC or FANCG; e.g., the gRNA can target a mutation as to FANCC, and the HDR can provide coding for proper expression of FANCC. An gRNA that targets the mutation(s) (e.g., one or more involved in FA, such as mutation(s) as to any one or more of FANCA, FANCC or FANCG)-and-Cas protein containing particle is contacted with HSCs carrying the mutation(s). The particle also can contain a suitable HDR template(s) to correct the mutation for proper expression of one or more of the proteins involved in FA, such as any one or more of FANCA, FANCC or FANCG; or the HSC can be contacted with a second particle or a vector that contains or delivers the HDR template. The so contacted cells can be administered; and optionally treated/expanded; cf. Cartier.

The particle in the herein discussion (e.g., as to containing gRNA(s) and Cas, optionally HDR template(s), or HDR template(s); for instance as to Hemophilia B, SCID, SCID-X1, ADA-SCID, Hereditary tyrosinemia, 0-thalassemia, X-linked CGD, Wiskott-Aldrich syndrome, Fanconi anemia, adrenoleukodystrophy (ALD), metachromatic leukodystrophy (MLD), HIV/AIDS, Immunodeficiency disorder, Hematologic condition, or genetic lysosomal storage disease) is advantageously obtained or obtainable from admixing an gRNA(s) and Cas protein mixture (optionally containing HDR template(s) or such mixture only containing HDR template(s) when separate particles as to template(s) is desired) with a mixture comprising or consisting essentially of or consisting of surfactant, phospholipid, biodegradable polymer, lipoprotein and alcohol (wherein one or more gRNA targets the genetic locus or loci in the HSC).

Indeed, the invention is especially suited for treating hematopoietic genetic disorders with genome editing, and immunodeficiency disorders, such as genetic immunodeficiency disorders, especially through using the particle technology herein-discussed. Genetic immunodeficiencies are diseases where genome editing interventions of the instant invention can successful. The reasons include: Hematopoietic cells, of which immune cells are a subset, are therapeutically accessible. They can be removed from the body and transplanted autologously or allogenically. Further, certain genetic immunodeficiencies, e.g., severe combined immunodeficiency (SCID), create a proliferative disadvantage for immune cells. Correction of genetic lesions causing SCID by rare, spontaneous 'reverse' mutations indicates that correcting even one lymphocyte progenitor may be sufficient to recover immune function in patients. . . /../../Users/t_kowalski/AppData/Local/Microsoft/Windows/Temporary Internet Files/Content.Outlook/GA8VY8LK/Treating SCID for Ellen.docx - _ENREF_1 See Bousso, P., et al. Diversity, functionality, and stability of the T cell repertoire derived in vivo from a single human T cell precursor. Proceedings of the National Academy of Sciences of the United States of America 97, 274-278 (2000). The selective advantage for edited cells allows for even low levels of editing to result in a therapeutic effect. This effect of the instant invention can be seen in SCID, Wiskott-Aldrich Syndrome, and the other conditions mentioned herein, including other genetic hematopoietic disorders such as alpha- and beta-thalassemia, where hemoglobin deficiencies negatively affect the fitness of erythroid progenitors.

The activity of NHEJ and HDR DSB repair varies significantly by cell type and cell state. NHEJ is not highly regulated by the cell cycle and is efficient across cell types, allowing for high levels of gene disruption in accessible target cell populations. In contrast, HDR acts primarily during S/G2 phase, and is therefore restricted to cells that are actively dividing, limiting treatments that require precise genome modifications to mitotic cells [Ciccia, A. & Elledge, S. J. Molecular cell 40, 179-204 (2010); Chapman, J. R., et al. Molecular cell 47, 497-510 (2012)].

The efficiency of correction via HDR may be controlled by the epigenetic state or sequence of the targeted locus, or the specific repair template configuration (single vs. double stranded, long vs. short homology arms) used [Hacein-Bey-Abina, S., et al. The New England journal of medicine 346, 1185-1193 (2002); Gaspar, H. B., et al. Lancet 364, 2181-2187 (2004); Beumer, K. J., et al. G3 (2013)]. The relative activity of NHEJ and HDR machineries in target cells may also affect gene correction efficiency, as these pathways may compete to resolve DSBs [Beumer, K. J., et al. Proceedings of the National Academy of Sciences of the United States of America 105, 19821-19826 (2008)]. HDR also imposes a delivery challenge not seen with NHEJ strategies, as it requires the concurrent delivery of nucleases and repair templates. In practice, these constraints have so far led to low levels of HDR in therapeutically relevant cell types. Clinical translation has therefore largely focused on NHEJ strategies to treat disease, although proof-of-concept preclinical HDR treatments have now been described for mouse models of Hemophilia B and hereditary tyrosinemia [Li, H., et al. Nature 475, 217-221 (2011); Yin, H., et al. Nature biotechnology 32, 551-553 (2014)].

Any given genome editing application may comprise combinations of proteins, small RNA molecules, and/or repair templates, making delivery of these multiple parts substantially more challenging than small molecule therapeutics. Two main strategies for delivery of genome editing tools have been developed: ex vivo and in vivo. In ex vivo treatments, diseased cells are removed from the body, edited and then transplanted back into the patient. Ex vivo editing has the advantage of allowing the target cell population to be well defined and the specific dosage of therapeutic molecules delivered to cells to be specified. The latter consideration may be particularly important when off-target modifications are a concern, as titrating the amount of nuclease may decrease such mutations (Hsu et al., 2013). Another advantage of ex vivo approaches is the typically high editing rates that can be achieved, due to the development of efficient delivery systems for proteins and nucleic acids into cells in culture for research and gene therapy applications.

There may be drawbacks with ex vivo approaches that limit application to a small number of diseases. For instance, target cells must be capable of surviving manipulation outside the body. For many tissues, like the brain, culturing cells outside the body is a major challenge, because cells either fail to survive, or lose properties necessary for their function in vivo. Thus, in view of this disclosure and the knowledge in the art, ex vivo therapy as to tissues with adult stem cell populations amenable to ex vivo culture and manipulation, such as the hematopoietic system, by the CRISPR-Cas system are enabled. [Bunn, H. F. & Aster, J. Pathophysiology of blood disorders, (McGraw-Hill, New York, 2011)]

In vivo genome editing involves direct delivery of editing systems to cell types in their native tissues. In vivo editing allows diseases in which the affected cell population is not amenable to ex vivo manipulation to be treated. Furthermore, delivering nucleases to cells in situ allows for the treatment of multiple tissue and cell types. These properties probably allow in vivo treatment to be applied to a wider range of diseases than ex vivo therapies.

To date, in vivo editing has largely been achieved through the use of viral vectors with defined, tissue-specific tropism. Such vectors are currently limited in terms of cargo carrying capacity and tropism, restricting this mode of therapy to organ systems where transduction with clinically useful vectors is efficient, such as the liver, muscle and eye [Kotterman, M. A. & Schaffer, D. V. Nature reviews. Genetics 15, 445-451 (2014); Nguyen, T. H. & Ferry, N. Gene therapy 11 Suppl 1, S76-84 (2004); Boye, S. E., et al. Molecular therapy: the journal of the American Society of Gene Therapy 21, 509-519 (2013)].

A potential barrier for in vivo delivery is the immune response that may be created in response to the large amounts of virus necessary for treatment, but this phenomenon is not unique to genome editing and is observed with other virus based gene therapies [Bessis, N., et al. Gene therapy 11 Suppl 1, S10-17 (2004)]. It is also possible that peptides from editing nucleases themselves are presented on MHC Class I molecules to stimulate an immune response, although there is little evidence to support this happening at the preclinical level. Another major difficulty with this mode of therapy is controlling the distribution and consequently the dosage of genome editing nucleases in vivo, leading to off-target mutation profiles that may be difficult to predict. However, in view of this disclosure and the knowledge in the art, including the use of virus- and particle-based therapies being used in the treatment of cancers, in vivo modification of HSCs, for instance by delivery by either particle or virus, is within the ambit of the the skilled person.

Ex Vivo Editing Therapy: The long standing clinical expertise with the purification, culture and transplantation of hematopoietic cells has made diseases affecting the blood system such as SCID, Fanconi anemia, Wiskott-Aldrich syndrome and sickle cell anemia the focus of ex vivo editing therapy. Another reason to focus on hematopoietic cells is that, thanks to previous efforts to design gene therapy for blood disorders, delivery systems of relatively high efficiency already exist. With these advantages, this mode of therapy can be applied to diseases where edited cells possess a fitness advantage, so that a small number of engrafted, edited cells can expand and treat disease. One such disease is HIV, where infection results in a fitness disadvantage to CD4+ T cells.

Ex vivo editing therapy has been recently extended to include gene correction strategies. The barriers to HDR ex vivo were overcome in a recent paper from Genovese and colleagues, who achieved gene correction of a mutated IL2RG gene in hematopoietic stem cells (HSCs) obtained from a patient suffering from SCID-X1 [Genovese, P., et al. Nature 510, 235-240 (2014)]. Genovese et. al. accomplished gene correction in HSCs using a multimodal strategy. First, HSCs were transduced using integration-deficient lentivirus containing an HDR template encoding a therapeutic cDNA for IL2RG. Following transduction, cells were electroporated with mRNA encoding ZFNs targeting a mutational hotspot in IL2RG to stimulate HDR based gene correction. To increase HDR rates, culture conditions were optimized with small molecules to encourage HSC division. With optimized culture conditions, nucleases and HDR templates, gene corrected HSCs from the SCID-X1 patient were obtained in culture at therapeutically relevant rates. HSCs from unaffected individuals that underwent the same gene correction procedure could sustain long-term hematopoiesis in mice, the gold standard for HSC function. HSCs are capable of giving rise to all hematopoietic cell types and can be autologously transplanted, making them an extremely valuable cell population for all hematopoietic genetic disorders [Weissman, I. L. & Shizuru, J. A. Blood 112, 3543-3553 (2008)]. Gene corrected HSCs could, in principle, be used to treat a wide range of genetic blood disorders making this study an exciting breakthrough for therapeutic genome editing.

In Vivo Editing Therapy: In vivo editing can be used advantageously from this disclosure and the knowledge in the art. For organ systems where delivery is efficient, there have already been a number of exciting preclinical therapeutic successes. The first example of successful in vivo editing therapy was demonstrated in a mouse model of Hemophilia B [Li, H., et al. Nature 475, 217-221 (2011)]. As noted earlier, Hemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications [Lofqvist, T., et al. Journal of internal medicine 241, 395-400 (1997)]. Thus, only low levels of HDR gene correction are necessary to change clinical outcomes for patients. In addition, Factor IX is synthesized and secreted by the liver, an organ that can be transduced efficiently by viral vectors encoding editing systems.

Using hepatotropic adeno-associated viral (AAV) serotypes encoding ZFNs and a corrective HDR template, up to 7% gene correction of a mutated, humanized Factor IX gene in the murine liver was achieved [Li, H., et al. Nature 475, 217-221 (2011)]. This resulted in improvement of clot formation kinetics, a measure of the function of the clotting cascade, demonstrating for the first time that in vivo editing therapy is not only feasible, but also efficacious. As discussed herein, the skilled person is positioned from the teachings herein and the knowledge in the art, e.g., Li to address Hemophilia B with a particle-containing HDR template and a CRISPR-Cas system that targets the mutation of the X-linked recessive disorder to reverse the loss-of-function mutation.

Building on this study, other groups have recently used in vivo genome editing of the liver with CRISPR-Cas to successfully treat a mouse model of hereditary tyrosinemia and to create mutations that provide protection against cardiovascular disease. These two distinct applications demonstrate the versatility of this approach for disorders that involve hepatic dysfunction [Yin, H., et al. Nature biotechnology 32, 551-553 (2014); Ding, Q., et al. Circulation research 115, 488-492 (2014)]. Application of in vivo editing to other organ systems are necessary to prove that this strategy is widely applicable. Currently, efforts to optimize both viral and non-viral vectors are underway to expand the range of disorders that can be treated with this mode of therapy [Kotterman, M. A. & Schaffer, D. V. Nature reviews. Genetics 15, 445-451 (2014); Yin, H., et al. Nature reviews. Genetics 15, 541-555 (2014)]. As discussed herein, the skilled person is positioned from the teachings herein and the knowledge in the art, e.g., Yin to address hereditary tyrosinemia with a particle-containing HDR template and a CRISPR-Cas system that targets the mutation.

Targeted deletion, therapeutic applications: Targeted deletion of genes may be preferred. Preferred are, therefore, genes involved in immunodeficiency disorder, hematologic condition, or genetic lysosomal storage disease, e.g., Hemophilia B, SCID, SCID-X1, ADA-SCID, Hereditary tyrosinemia, β-thalassemia, X-linked CGD, Wiskott-Aldrich syndrome, Fanconi anemia, adrenoleukodystrophy (ALD), metachromatic leukodystrophy (MLD), HIV/AIDS, other metabolic disorders, genes encoding mis-folded proteins involved in diseases, genes leading to loss-of-function involved in diseases; generally, mutations that can be targeted in an HSC, using any herein-discussed delivery system, with the particle system considered advantageous.

In the present invention, the immunogenicity of the CRISPR enzyme in particular may be reduced following the approach first set out in Tangri et al with respect to erythropoietin and subsequently developed. Accordingly, directed evolution or rational design may be used to reduce the immunogenicity of the CRISPR enzyme (for instance a Cpf1) in the host species (human or other species).

Genome editing: The CRISPR/Cas systems of the present invention can be used to correct genetic mutations that were previously attempted with limited success using TALEN and ZFN and lentiviruses, including as herein discussed; see also WO2013163628.

Treating Disease of the Brain, Central Nervous and Immune Systems

The present invention also contemplates delivering the CRISPR-Cas system to the brain or neurons. For example, RNA interference (RNAi) offers therapeutic potential for this disorder by reducing the expression of HTT, the disease-causing gene of Huntington's disease (see, e.g., McBride et al., Molecular Therapy vol. 19 no. 12 Dec. 2011, pp. 2152-2162), therefore Applicant postulates that it may be used/and or adapted to the CRISPR-Cas system. The CRISPR-Cas system may be generated using an algorithm to reduce the off-targeting potential of antisense sequences. The CRISPR-Cas sequences may target either a sequence in exon 52 of mouse, rhesus or human huntingtin and expressed in a viral vector, such as AAV. Animals, including humans, may be injected with about three microinjections per hemisphere (six injections total): the first 1 mm rostral to the anterior commissure (12 µl) and the two remaining injections (12 µl and 10 µl, respectively) spaced 3 and 6 mm caudal to the first injection with 1 e12 vg/ml of AAV at a rate of about 1 l/minute, and the needle was left in place for an additional 5 minutes to allow the injectate to diffuse from the needle tip.

DiFiglia et al. (PNAS, Oct. 23, 2007, vol. 104, no. 43, 17204-17209) observed that single administration into the adult striatum of an siRNA targeting Htt can silence mutant Htt, attenuate neuronal pathology, and delay the abnormal behavioral phenotype observed in a rapid-onset, viral transgenic mouse model of HD. DiFiglia injected mice intrastriatally with 2 µl of Cy3-labeled cc-siRNA-Htt or unconjugated siRNA-Htt at 10 M. A similar dosage of CRISPR Cas targeted to Htt may be contemplated for humans in the present invention, for example, about 5-10 ml of 10 µM CRISPR Cas targeted to Htt may be injected intrastriatally.

In another example, Boudreau et al. (Molecular Therapy vol. 17 no. 6 Jun. 2009) injects 5 µl of recombinant AAV serotype 2/1 vectors expressing htt-specific RNAi virus (at 4×10$^{12}$ viral genomes/ml) into the straiatum. A similar dosage of CRISPR Cas targeted to Htt may be contemplated for humans in the present invention, for example, about 10-20 ml of 4×10$^{12}$ viral genomes/ml) CRISPR Cas targeted to Htt may be injected intrastriatally.

In another example, a CRISPR Cas targetd to HTT may be administered continuously (see, e.g., Yu et al., Cell 150, 895-908, Aug. 31, 2012). Yu et al. utilizes osmotic pumps delivering 0.25 ml/hr (Model 2004) to deliver 300 mg/day of ss-siRNA or phosphate-buffered saline (PBS) (Sigma Aldrich) for 28 days, and pumps designed to deliver 0.5 µl/hr (Model 2002) were used to deliver 75 mg/day of the positive control MOE ASO for 14 days. Pumps (Durect Corporation) were filled with ss-siRNA or MOE diluted in sterile PBS and then incubated at 37 C for 24 or 48 (Model 2004) hours prior to implantation. Mice were anesthetized with 2.5% isofluorane, and a midline incision was made at the base of the skull. Using stereotaxic guides, a cannula was implanted into the right lateral ventricle and secured with Loctite adhesive. A catheter attached to an Alzet osmotic mini pump was attached to the cannula, and the pump was placed subcutaneously in the midscapular area. The incision was closed with 5.0 nylon sutures. A similar dosage of CRISPR Cas targeted to Htt may be contemplated for humans in the present invention, for example, about 500 to 1000 g/day CRISPR Cas targeted to Htt may be administered.

In another example of continuous infusion, Stiles et al. (Experimental Neurology 233 (2012) 463-471) implanted an intraparenchymal catheter with a titanium needle tip into the right putamen. The catheter was connected to a SynchroMed® II Pump (Medtronic Neurological, Minneapolis, MN) subcutaneously implanted in the abdomen. After a 7 day infusion of phosphate buffered saline at 6 L/day, pumps were re-filled with test article and programmed for continuous delivery for 7 days. About 2.3 to 11.52 mg/d of siRNA were infused at varying infusion rates of about 0.1 to 0.5 L/min. A similar dosage of CRISPR Cas targeted to Htt may be contemplated for humans in the present invention, for example, about 20 to 200 mg/day CRISPR Cas targeted to Htt may be administered. In another example, the methods of US Patent Publication No. 20130253040 assigned to Sangamo may also be also be adapted from TALES to the nucleic acid-targeting system of the present invention for treating Huntington's Disease.

In another example, the methods of US Patent Publication No. 20130253040 (WO2013130824) assigned to Sangamo may also be adapted from TALES to the CRISPR Cas system of the present invention for treating Huntington's Disease.

WO2015089354 A1 in the name of The Broad Institute et al., hereby incorporated by reference, describes targets for Huntington's Disease (HP). Possible target genes of CRISPR complex in regard to Huntington's Disease: PRKCE; IGF1; EP300; RCOR1; PRKCZ; HDAC4; and TGM2. Accordingly, one or more of PRKCE; IGF1; EP300; RCOR1; PRKCZ; HDAC4; and TGM2 may be selected as targets for Huntington's Disease in some embodiments of the present invention.

Other trinucleotide repeat disorders. These may include any of the following: Category I includes Huntington's disease (HD) and the spinocerebellar ataxias; Category II expansions are phenotypically diverse with heterogeneous expansions that are generally small in magnitude, but also found in the exons of genes; and Category III includes fragile X syndrome, myotonic dystrophy, two of the spinocerebellar ataxias, juvenile myoclonic epilepsy, and Friedreich's ataxia.

A further aspect of the invention relates to utilizing the CRISPR-Cas system for correcting defects in the EMP2A and EMP2B genes that have been identified to be associated with Lafora disease. Lafora disease is an autosomal recessive condition which is characterized by progressive myoclonus epilepsy which may start as epileptic seizures in adolescence. A few cases of the disease may be caused by mutations in genes yet to be identified. The disease causes seizures, muscle spasms, difficulty walking, dementia, and eventually death. There is currently no therapy that has proven effective against disease progression. Other genetic abnormalities associated with epilepsy may also be targeted by the CRISPR-Cas system and the underlying genetics is further described in Genetics of Epilepsy and Genetic Epilepsies, edited by Giuliano Avanzini, Jeffrey L. Noebels, Mariani Foundation Paediatric Neurology:20; 2009).

The methods of US Patent Publication No. 20110158957 assigned to Sangamo BioSciences, Inc. involved in inactivating T cell receptor (TCR) genes may also be modified to the CRISPR Cas system of the present invention. In another example, the methods of US Patent Publication No. 20100311124 assigned to Sangamo BioSciences, Inc. and US Patent Publication No. 20110225664 assigned to Cellectis, which are both involved in inactivating glutamine synthetase gene expression genes may also be modified to the CRISPR Cas system of the present invention.

Delivery options for the brain include encapsulation of CRISPR enzyme and guide RNA in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors containing CRISPR enzyme and guide RNA. For instance, Xia CF and Boado R J, Pardridge WM ("Antibody-mediated targeting of siRNA via the human insulin receptor using avidin-biotin technology." Mol Pharm. 2009 May-June;6(3):747-51. doi: 10.1021/mp800194) describes how delivery of short interfering RNA (siRNA) to cells in culture, and in vivo, is possible with combined use of a receptor-specific monoclonal antibody (mAb) and avidin-biotin technology. The authors also report that because the bond between the targeting mAb and the siRNA is stable with avidin-biotin technology, and RNAi effects at distant sites such as brain are observed in vivo following an intravenous administration of the targeted siRNA.

Zhang et al. (Mol Ther. 2003 January;7(1):11-8.)) describe how expression plasmids encoding reporters such as luciferase were encapsulated in the interior of an "artificial virus" comprised of an 85 nm pegylated immunoliposome, which was targeted to the rhesus monkey brain in vivo with a monoclonal antibody (MAb) to the human insulin receptor (HIR). The HIRMAb enables the liposome carrying the exogenous gene to undergo transcytosis across the blood-brain barrier and endocytosis across the neuronal plasma membrane following intravenous injection. The level of luciferase gene expression in the brain was 50-fold higher in the rhesus monkey as compared to the rat. Widespread neuronal expression of the beta-galactosidase gene in primate brain was demonstrated by both histochemistry and confocal microscopy. The authors indicate that this approach makes feasible reversible adult transgenics in 24 hours. Accordingly, the use of immunoliposome is preferred. These may be used in conjunction with antibodies to target specific tissues or cell surface proteins.

Alzheimer's Disease

US Patent Publication No. 20110023153, describes use of zinc finger nucleases to genetically modify cells, animals and proteins associated with Alzheimer's Disease. Once modified cells and animals may be further tested using known methods to study the effects of the targeted mutations on the development and/or progression of AD using measures commonly used in the study of AD—such as, without limitation, learning and memory, anxiety, depression, addiction, and sensory motor functions as well as assays that measure behavioral, functional, pathological, metabolic and biochemical function.

The present disclosure comprises editing of any chromosomal sequences that encode proteins associated with AD. The AD-related proteins are typically selected based on an experimental association of the AD-related protein to an AD disorder. For example, the production rate or circulating concentration of an AD-related protein may be elevated or depressed in a population having an AD disorder relative to a population lacking the AD disorder. Differences in protein levels may be assessed using proteomic techniques including but not limited to Western blot, immunohistochemical staining, enzyme linked immunosorbent assay (ELISA), and mass spectrometry. Alternatively, the AD-related proteins may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Examples of Alzheimer's disease associated proteins may include the very low density lipoprotein receptor protein (VLDLR) encoded by the VLDLR gene, the ubiquitin-like modifier activating enzyme 1 (UBA1) encoded by the UBA1 gene, or the NEDD8-activating enzyme El catalytic subunit protein (UBE1C) encoded by the UBA3 gene, for example.

By way of non-limiting example, proteins associated with AD include but are not limited to the proteins listed as follows: Chromosomal Sequence Encoded Protein ALAS2 Delta-aminolevulinate synthase 2 (ALAS2) ABCA1 ATP-binding cassette transporter (ABCA1) ACE Angiotensin I-converting enzyme (ACE) APOE Apolipoprotein E precursor (APOE) APP amyloid precursor protein (APP) AQP1 aquaporin 1 protein (AQP1) BIN1 Myc box-dependent-interacting protein 1 or bridging integrator 1 protein (BIN1) BDNF brain-derived neurotrophic factor (BDNF) BTNL8 Butyrophilin-like protein 8 (BTNL8) $C_1$ORF49 chromosome 1 open reading frame 49 CDH4 Cadherin-4 CHRNB2 Neuronal acetylcholine receptor subunit beta-2 CKLFSF2 CKLF-like MARVEL transmembrane domain-containing protein 2 (CKLFSF2) CLEC4E C-type lectin domain family 4, member e (CLEC4E) CLU clusterin protein (also known as apolipoprotein J) CR1 Erythrocyte complement receptor 1 (CR1, also known as CD35, $C_3b/C_4b$ receptor and immune adherence receptor) CR1L Erythrocyte complement receptor 1 (CR1L) CSF3R granulocyte colony-stimulating factor 3 receptor (CSF3R) CST3 Cystatin C or cystatin 3 CYP2C Cytochrome P450 2C DAPK1 Death-associated protein kinase 1 (DAPK1) ESR1 Estrogen receptor 1 FCAR Fc fragment of IgA receptor (FCAR, also known as CD89) FCGR3B Fc fragment of IgG, low affinity IIIb, receptor (FCGR3B or CD16b) FFA2 Free fatty acid receptor 2 (FFA2) FGA Fibrinogen (Factor I) GAB2 GRB2-associated-binding protein 2 (GAB2) GAB2 GRB2-associated-binding protein 2 (GAB2) GALP Galanin-like peptide GAPDHS Glyceraldehyde-3-phosphate dehydrogenase, spermatogenic (GAPDHS) GMPB GMBP HP Haptoglobin (HP) HTR7 5-hydroxytryptamine (serotonin) receptor 7 (adenylate cyclase-coupled) IDE Insulin degrading enzyme IF127 IF127 IFI6 Interferon, alpha-inducible protein 6 (IFI6) IFIT2 Interferon-induced protein with tetratricopeptide repeats 2 (IFIT2) IL1RN interleukin-1 receptor antagonist (IL-iRA) IL8RA Interleukin 8 receptor, alpha (IL8RA or CD181) IL8RB Interleukin 8 receptor, beta (IL8RB) JAG1 Jagged 1 (JAG1) KCNJ15 Potassium inwardly-rectifying channel, subfamily J, member 15 (KCNJ15) LRP6 Low-density lipoprotein receptor-related protein 6 (LRP6) MAPT microtubule-associated protein tau (MAPT) MARK4 MAP/microtubule affinity-regulating kinase 4 (MARK4) MPHOSPHI M-phase phosphoprotein 1 MTHFR 5,10-methylenetetrahydrofolate reductase MX2 Interferon-induced GTP-binding protein Mx2 NBN Nibrin, also known as NBN NCSTN Nicastrin NIACR2 Niacin receptor 2 (NIACR2, also known as GPR109B) NMNAT3 nicotinamide nucleotide adenylyltransferase 3 NTM Neurotrimin (or HNT) ORM1 Orosmucoid 1 (ORM1) or Alpha-i-acid glycoprotein 1 P2RY13 P2Y purinoceptor 13 (P2RY13) PBEF1 Nicotinamide phosphoribosyltransferase (NAmPRTase or Nampt) also known as pre-B-cell colony-enhancing factor 1 (PBEF1) or visfatin PCK1 Phosphoenolpyruvate carboxykinase PICALM phosphatidylinositol binding clathrin assembly protein (PICALM) PLAU Urokinase-type plasminogen activator (PLAU) PLXNC1 Plexin $C_1$ (PLXNC1) PRNP Prion protein PSEN1 presenilin 1 protein (PSEN1) PSEN2 presenilin 2 protein (PSEN2) PTPRA protein tyrosine phosphatase receptor type A protein (PTPRA) RALGPS2 Ral GEF with PH domain and SH3 binding motif 2 (RALGPS2) RGSL2 regulator of G-protein signaling like 2 (RGSL2) SELENBP1 Selenium binding protein 1 (SELNBP1) SLC25A37 Mitoferrin-1 SORL1 sortilin-related receptor L(DLR class) A repeats-containing protein (SORL1) TF Transferrin TFAM Mitochondrial transcription factor A TNF Tumor necrosis factor TNFRSF10C Tumor necrosis factor receptor superfamily member 10C (TNFRSF10C) TNFSF10 Tumor necrosis factor receptor superfamily, (TRAIL) member 10a (TNFSF10) UBA1 ubiquitin-like modifier activating enzyme 1 (UBA1) UBA3 NEDD8-activating enzyme El catalytic subunit protein (UBEIC) UBB ubiquitin B protein (UBB) UBQLN1 Ubiquilin-1 UCHL1 ubiquitin carboxyl-terminal esterase L1 protein (UCHL1) UCHL3 ubiquitin carboxyl-terminal hydrolase isozyme L3 protein (UCHL3) VLDLR very low density lipoprotein receptor protein (VLDLR).

In exemplary embodiments, the proteins associated with AD whose chromosomal sequence is edited may be the very low density lipoprotein receptor protein (VLDLR) encoded by the VLDLR gene, the ubiquitin-like modifier activating enzyme 1 (UBA1) encoded by the UBA1 gene, the NEDD8-activating enzyme El catalytic subunit protein (UBE1C)

encoded by the UBA3 gene, the aquaporin 1 protein (AQP1) encoded by the AQP1 gene, the ubiquitin carboxyl-terminal esterase L1 protein (UCHL1) encoded by the UCHL1 gene, the ubiquitin carboxyl-terminal hydrolase isozyme L3 protein (UCHL3) encoded by the UCHL3 gene, the ubiquitin B protein (UBB) encoded by the UBB gene, the microtubule-associated protein tau (MAPT) encoded by the MAPT gene, the protein tyrosine phosphatase receptor type A protein (PTPRA) encoded by the PTPRA gene, the phosphatidylinositol binding clathrin assembly protein (PICALM) encoded by the PICALM gene, the clusterin protein (also known as apoplipoprotein J) encoded by the CLU gene, the presenilin 1 protein encoded by the PSEN1 gene, the presenilin 2 protein encoded by the PSEN2 gene, the sortilin-related receptor L(DLR class) A repeats-containing protein (SORL1) protein encoded by the SORL1 gene, the amyloid precursor protein (APP) encoded by the APP gene, the Apolipoprotein E precursor (APOE) encoded by the APOE gene, or the brain-derived neurotrophic factor (BDNF) encoded by the BDNF gene. In an exemplary embodiment, the genetically modified animal is a rat, and the edited chromosomal sequence encoding the protein associated with AD is as as follows: APP amyloid precursor protein (APP) NM_019288 AQP1 aquaporin 1 protein (AQP1) NM_012778 BDNF Brain-derived neurotrophic factor NM_012513 CLU clusterin protein (also known as NM_053021 apoplipoprotein J) MAPT microtubule-associated protein NM_017212 tau (MAPT) PICALM phosphatidylinositol binding NM_053554 clathrin assembly protein (PICALM) PSEN1 presenilin 1 protein (PSEN1) NM_019163 PSEN2 presenilin 2 protein (PSEN2) NM_031087 PTPRA protein tyrosine phosphatase NM_012763 receptor type A protein (PTPRA) SORL1 sortilin-related receptor L(DLR NM_053519, class) A repeats-containing XM_001065506, protein (SORL1) XM_217115 UBA1 ubiquitin-like modifier activating NM_001014080 enzyme 1 (UBA1) UBA3 NEDD8-activating enzyme E1 NM_057205 catalytic subunit protein (UBE1C) UBB ubiquitin B protein (UBB) NM_138895 UCHL1 ubiquitin carboxyl-terminal NM_017237 esterase L1 protein (UCHL1) UCHL3 ubiquitin carboxyl-terminal NM_001110165 hydrolase isozyme L3 protein (UCHL3) VLDLR very low density lipoprotein NM_013155 receptor (VLDLR).

The animal or cell may comprise 1, 2, 3, 4, 5, 6, 7, 8, 9,10, 11, 12, 13, 14, 15 or more disrupted chromosomal sequences encoding a protein associated with AD and zero, 1, 2, 3, 4, 5, 6, 7, 8, 9, 10, 11, 12, 13, 14, 15 or more chromosomally integrated sequences encoding a protein associated with AD.

The edited or integrated chromosomal sequence may be modified to encode an altered protein associated with AD. A number of mutations in AD-related chromosomal sequences have been associated with AD. For instance, the V7171 (i.e. valine at position 717 is changed to isoleucine) missense mutation in APP causes familial AD. Multiple mutations in the presenilin-1 protein, such as H163R (i.e. histidine at position 163 is changed to arginine), A246E (i.e. alanine at position 246 is changed to glutamate), $L^{286}V$ (i.e. leucine at position 286 is changed to valine) and $C_{410}Y$ (i.e. cysteine at position 410 is changed to tyrosine) cause familial Alzheimer's type 3. Mutations in the presenilin-2 protein, such as N141 I (i.e. asparagine at position 141 is changed to isoleucine), M239V (i.e. methionine at position 239 is changed to valine), and D439A (i.e. aspartate at position 439 is changed to alanine) cause familial Alzheimer's type 4. Other associations of genetic variants in AD-associated genes and disease are known in the art. See, for example, Waring et al. (2008) Arch. Neurol. 65:329-334, the disclosure of which is incorporated by reference herein in its entirety.

Secretase Disorders

US Patent Publication No. 20110023146, describes use of zinc finger nucleases to genetically modify cells, animals and proteins associated with secretase-associated disorders. Secretases are essential for processing pre-proteins into their biologically active forms. Defects in various components of the secretase pathways contribute to many disorders, particularly those with hallmark amyloidogenesis or amyloid plaques, such as Alzheimer's disease (AD).

A secretase disorder and the proteins associated with these disorders are a diverse set of proteins that effect susceptibility for numerous disorders, the presence of the disorder, the severity of the disorder, or any combination thereof. The present disclosure comprises editing of any chromosomal sequences that encode proteins associated with a secretase disorder. The proteins associated with a secretase disorder are typically selected based on an experimental association of the secretase—related proteins with the development of a secretase disorder. For example, the production rate or circulating concentration of a protein associated with a secretase disorder may be elevated or depressed in a population with a secretase disorder relative to a population without a secretase disorder. Differences in protein levels may be assessed using proteomic techniques including but not limited to Western blot, immunohistochemical staining, enzyme linked immunosorbent assay (ELISA), and mass spectrometry. Alternatively, the protein associated with a secretase disorder may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with a secretase disorder include PSENEN (presenilin enhancer 2 homolog (*C. elegans*)), CTSB (cathepsin B), PSEN1 (presenilin 1), APP (amyloid beta (A4) precursor protein), APH1B (anterior pharynx defective 1 homolog B (*C. elegans*)), PSEN2 (presenilin 2 (Alzheimer disease 4)), BACE1 (beta-site APP-cleaving enzyme 1), ITM2B (integral membrane protein 2B), CTSD (cathepsin D), NOTCH1 (Notch homolog 1, translocation-associated (*Drosophila*)), TNF (tumor necrosis factor (TNF superfamily, member 2)), INS (insulin), DYT10 (dystonia 10), ADAM17 (ADAM metallopeptidase domain 17), APOE (apolipoprotein E), ACE (angiotensin I converting enzyme (peptidyl-dipeptidase A) 1), STN (statin), TP53 (tumor protein p53), IL6 (interleukin 6 (interferon, beta 2)), NGFR (nerve growth factor receptor (TNFR superfamily, member 16)), IL1B (interleukin 1, beta), ACHE (acetylcholinesterase (Yt blood group)), CTNNB1 (catenin (cadherin-associated protein), beta 1, 88 kDa), IGF1 (insulin-like growth factor 1 (somatomedin C)), IFNG (interferon, gamma), NRG1 (neuregulin 1), CASP3 (caspase 3, apoptosis-related cysteine peptidase), MAPK1 (mitogen-activated protein kinase 1), CDH1 (cadherin 1, type 1, E-cadherin (epithelial)), APBB1 (amyloid beta (A4) precursor protein-binding, family B, member 1 (Fe65)), HMGCR (3-hydroxy-3-methylglutaryl-Coenzyme A reductase), CREB1 (cAMP responsive element binding protein 1), PTGS2 (prostaglandin-endoperoxide synthase 2 (prostaglandin G/H synthase and cyclooxygenase)), HES1 (hairy and enhancer of split 1, (*Drosophila*)), CAT (catalase), TGFB1 (transforming growth factor, beta 1), ENO2 (enolase 2 (gamma, neuronal)), ERBB4 (v-erb-a erythroblastic leukemia viral oncogene homolog 4 (avian)), TRAPPC10 (trafficking protein particle complex 10), MAOB (monoamine oxidase B), NGF (nerve growth factor (beta polypeptide)), MMPP12 (matrix metallopeptidase 12 (macrophage elastase)), JAG1 (jagged 1 (Alagille syndrome)), CD40LG (CD40 ligand), PPARG (peroxisome proliferator-activated receptor gamma), FGF2 (fibroblast growth factor 2 (basic)), IL3 (interleukin 3 (colony-stimulating factor, multiple)), LRP1 (low density lipoprotein receptor-related protein 1), NOTCH4 (Notch homolog 4 (Drosophila)), MAPK8 (mitogen-activated protein kinase 8), PREP (prolyl endopeptidase), NOTCH3 (Notch homolog 3 (Drosophila)), PRNP (prion protein), CTSG (cathepsin G), EGF (epidermal growth factor (beta-urogastrone)), REN (renin), CD44 (CD44 molecule (Indian blood group)), SELP (selectin P (granule membrane protein 140 kDa, antigen CD62)), GHR (growth hormone receptor), ADCYAP1 (adenylate cyclase activating polypeptide 1 (pituitary)), INSR (insulin receptor), GFAP (glial fibrillary acidic protein), MMP3 (matrix metallopeptidase 3 (stromelysin 1, progelatinase)), MAPK10 (mitogen-activated protein kinase 10), SPi (Spi transcription factor), MYC (v-myc myelocytomatosis viral oncogene homolog (avian)), CTSE (cathepsin E), PPARA (peroxisome proliferator-activated receptor alpha), JUN (jun oncogene), TIMP1 (TIMP metallopeptidase inhibitor 1), TL5 (interleukin 5 (colony-stimulating factor, eosinophil)), IL1A (interleukin 1, alpha), MMP9 (matrix metallopeptidase 9 (gelatinase B, 92 kDa gelatinase, 92 kDa type IV collagenase)), HTR4 (5-hydroxytryptamine (serotonin) receptor 4), HSPG2 (heparan sulfate proteoglycan 2), KRAS (v-Ki-ras2 Kirsten rat sarcoma viral oncogene homolog), CYCS (cytochrome c, somatic), SMG1 (SMG1 homolog, phosphatidylinositol 3-kinase-related kinase (C. elegans)), IL1R1 (interleukin 1 receptor, type I), PROK1 (prokineticin 1), MAPK3 (mitogen-activated protein kinase 3), NTRK1 (neurotrophic tyrosine kinase, receptor, type 1), IL13 (interleukin 13), MME (membrane metallo-endopeptidase), TKT (transketolase), CXCR2 (chemokine (C-X-C motif) receptor 2), IGF1R (insulin-like growth factor 1 receptor), RARA (retinoic acid receptor, alpha), CREBBP (CREB binding protein), PTGS1 (prostaglandin-endoperoxide synthase 1 (prostaglandin G/H synthase and cyclooxygenase)), GALT (galactose-1-phosphate uridylyltransferase), CHRM1 (cholinergic receptor, muscarinic 1), ATXN1 (ataxin 1), PAWR (PRKC, apoptosis, WT1, regulator), NOTCH2 (Notch homolog 2 (Drosophila)), M6PR (mannose-6-phosphate receptor (cation dependent)), CYP46A1 (cytochrome P450, family 46, subfamily A, polypeptide 1), CSNK1 D (casein kinase 1, delta), MAPK14 (mitogen-activated protein kinase 14), PRG2 (proteoglycan 2, bone marrow (natural killer cell activator, eosinophil granule major basic protein)), PRKCA (protein kinase C, alpha), $L^1$ CAM ($L^1$ cell adhesion molecule), CD40 (CD40 molecule, TNF receptor superfamily member 5), NR1I2 (nuclear receptor subfamily 1, group I, member 2), JAG2 (jagged 2), CTNND1 (catenin (cadherin-associated protein), delta 1), CDH2 (cadherin 2, type 1, N-cadherin (neuronal)), CMA1 (chymase 1, mast cell), SORT1 (sortilin 1), DLK1 (delta-like 1 homolog (Drosophila)), THEM4 (thioesterase superfamily member 4), JUP (junction plakoglobin), CD46 (CD46 molecule, complement regulatory protein), CCL11 (chemokine (C-C motif) ligand 11), CAV3 (caveolin 3), RNASE3 (ribonuclease, RNase A family, 3 (eosinophil cationic protein)), HSPA8 (heat shock 70 kDa protein 8), CASP9 (caspase 9, apoptosis-related cysteine peptidase), CYP3A4 (cytochrome P450, family 3, subfamily A, polypeptide 4), CCR3 (chemokine (C-C motif) receptor 3), TFAP2A (transcription factor AP-2 alpha (activating enhancer binding protein 2 alpha)), SCP2 (sterol carrier protein 2), CDK4 (cyclin-dependent kinase 4), HIF1A (hypoxia inducible factor 1, alpha subunit (basic helix-loop-helix transcription factor)), $TCF7L^2$ (transcription factor 7-like 2 (T-cell specific, HMG-box)), IL1R2 (interleukin 1 receptor, type II), B3GALTL (beta 1,3-galactosyltransferase-like), MDM2 (Mdm2 p53 binding protein homolog (mouse)), RELA (v-rel reticuloendotheliosis viral oncogene homolog A (avian)), CASP7 (caspase 7, apoptosis-related cysteine peptidase), IDE (insulin-degrading enzyme), FABP4 (fatty acid binding protein 4, adipocyte), CASK (calcium/calmodulin-dependent serine protein kinase (MAGUK family)), ADCYAP1R1 (adenylate cyclase activating polypeptide 1 (pituitary) receptor type I), ATF4 (activating transcription factor 4 (tax-responsive enhancer element B67)), PDGFA (platelet-derived growth factor alpha polypeptide), $C_{21}$ or f33 (chromosome 21 open reading frame 33), SCG5 (secretogranin V (7B2 protein)), RNF123 (ring finger protein 123), NFKB1 (nuclear factor of kappa light polypeptide gene enhancer in B-cells 1), ERBB2 (v-erb-b2 erythroblastic leukemia viral oncogene homolog 2, neuro/glioblastoma derived oncogene homolog (avian)), CAV1 (caveolin 1, caveolae protein, 22 kDa), MMP7 (matrix metallopeptidase 7 (matrilysin, uterine)), TGFA (transforming growth factor, alpha), RXRA (retinoid X receptor, alpha), STX1A (syntaxin 1A (brain)), PSMC4 (proteasome (prosome, macropain) 26S subunit, ATPase, 4), P2RY2 (purinergic receptor P2Y, G-protein coupled, 2), TNFRSF21 (tumor necrosis factor receptor superfamily, member 21), DLG1 (discs, large homolog 1 (Drosophila)), NUMBL (numb homolog (Drosophila)-like), SPN (sialophorin), PLSCR1 (phospholipid scramblase 1), UBQLN2 (ubiquilin 2), UBQLN1 (ubiquilin 1), PCSK7 (proprotein convertase subtilisin/kexin type 7), SPON1 (spondin 1, extracellular matrix protein), SILV (silver homolog (mouse)), QPCT (glutaminyl-peptide cyclotransferase), HESS (hairy and enhancer of split 5 (Drosophila)), GCC1 (GRIP and coiled-coil domain containing 1), and any combination thereof.

The genetically modified animal or cell may comprise 1, 2, 3, 4, 5, 6, 7, 8, 9, 10 or more disrupted chromosomal sequences encoding a protein associated with a secretase disorder and zero, 1, 2, 3, 4, 5, 6, 7, 8, 9, 10 or more chromosomally integrated sequences encoding a disrupted protein associated with a secretase disorder.

ALS

US Patent Publication No. 20110023144, describes use of zinc finger nucleases to genetically modify cells, animals and proteins associated with amyotrophyic lateral sclerosis (ALS) disease. ALS is characterized by the gradual steady degeneration of certain nerve cells in the brain cortex, brain stem, and spinal cord involved in voluntary movement.

Motor neuron disorders and the proteins associated with these disorders are a diverse set of proteins that effect susceptibility for developing a motor neuron disorder, the presence of the motor neuron disorder, the severity of the motor neuron disorder or any combination thereof. The present disclosure comprises editing of any chromosomal sequences that encode proteins associated with ALS disease, a specific motor neuron disorder. The proteins associated with ALS are typically selected based on an experimental association of ALS—related proteins to ALS. For example, the production rate or circulating concentration of a protein associated with ALS may be elevated or depressed in a population with ALS relative to a population without ALS. Differences in protein levels may be assessed using proteomic techniques including but not limited to Western blot, immunohistochemical staining, enzyme linked immunosorbent assay (ELISA), and mass spectrometry. Alternatively, the proteins associated with ALS may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with ALS include but are not limited to the following proteins: SOD1 superoxide dismutase 1, ALS3 amyotrophic lateral soluble sclerosis 3 SETX senataxin ALS5 amyotrophic lateral sclerosis 5 FUS fused in sarcoma ALS7 amyotrophic lateral sclerosis 7 ALS2 amyotrophic lateral DPP6 Dipeptidyl-peptidase 6 sclerosis 2 NEFH neurofilament, heavy PTGS1 prostaglandin-polypeptide endoperoxide synthase 1 SLC1A2 solute carrier family 1 TNFRSF10B tumor necrosis factor (glial high affinity receptor superfamily, glutamate transporter), member 10b member 2 PRPH peripherin HSP90AA1 heat shock protein 90 kDa alpha (cytosolic), class A member 1 GRIA2 glutamate receptor, IFNG interferon, gamma ionotropic, AMPA 2 S100B S100 calcium binding FGF2 fibroblast growth factor 2 protein B AOX1 aldehyde oxidase 1 CS citrate synthase TARDBP TAR DNA binding protein TXN thioredoxin RAPH1 Ras association MAP3K5 mitogen-activated protein (RaIGDS/AF-6) and kinase 5 pleckstrin homology domains 1 NBEAL1 neurobeachin-like 1 GPX1 glutathione peroxidase 1 ICA1L islet cell autoantigen RAC1 ras-related $C_3$ botulinum 1.69 kDa-like toxin substrate 1 MAPT microtubule-associated ITPR2 inositol 1,4,5- protein tau triphosphate receptor, type 2 ALS2CR4 amyotrophic lateral GLS glutaminase sclerosis 2 (juvenile) chromosome region, candidate 4 ALS2CR8 amyotrophic lateral CNTFR ciliary neurotrophic factor sclerosis 2 (juvenile) receptor chromosome region, candidate 8 ALS2CR11 amyotrophic lateral FOLH1 folate hydrolase 1 sclerosis 2 (juvenile) chromosome region, candidate 11 FAM117B family with sequence P4HB prolyl 4-hydroxylase, similarity 117, member B beta polypeptide CNTF ciliary neurotrophic factor SQSTM1 sequestosome 1 STRADB STE20-related kinase NAIP NLR family, apoptosis adaptor beta inhibitory protein YWHAQ tyrosine 3- SLC33A1 solute carrier family 33 monooxygenase/tryptoph (acetyl-CoA transporter), an 5-monooxygenase member 1 activation protein, theta polypeptide TRAK2 trafficking protein, homolog, SAC1 kinesin binding 2 µlipid phosphatase domain containing NIF3L$^1$ NIF3 NGG1 interacting INA internexin neuronal factor 3-like 1 intermediate filament protein, alpha PARD3B par-3 partitioning COX8A cytochrome c oxidase defective 3 homolog B subunit VIIIA CDK15 cyclin-dependent kinase HECW1 HECT, $C_2$ and WW 15 domain containing E3 ubiquitin protein ligase 1 NOS1 nitric oxide synthase 1 MET met proto-oncogene SOD2 superoxide dismutase 2, HSPB1 heat shock 27 kDa mitochondrial protein 1 NEFL neurofilament, light CTSB cathepsin B polypeptide ANG angiogenin, HSPA8 heat shock 70 kDa ribonuclease, RNase A protein 8 family, 5 VAPB VAMP (vesicle- ESR1 estrogen receptor 1 associated membrane protein)-associated protein B and C SNCA synuclein, alpha HGF hepatocyte growth factor CAT catalase ACTB actin, beta NEFM neurofilament, medium TH tyrosine hydroxylase polypeptide BCL2 B-cell CLL/lymphoma 2 FAS Fas (TNF receptor superfamily, member 6) CASP3 caspase 3, apoptosis-CLU clusterin related cysteine peptidase SMN1 survival of motor neuron G6PD glucose-6-phosphate 1, telomeric dehydrogenase BAX BCL2-associated X HSF1 heat shock transcription protein factor 1 RNF19A ring finger protein 19A JUN jun oncogene ALS2CR12 amyotrophic lateral HSPA5 heat shock 70 kDa sclerosis 2 (juvenile) protein 5 chromosome region, candidate 12 MAPK14 mitogen-activated protein IL10 interleukin 10 kinase 14 APEX1 APEX nuclease TXNRD1 thioredoxin reductase 1 (multifunctional DNA repair enzyme) 1 NOS2 nitric oxide synthase 2, TIMP1 TIMP metallopeptidase inducible inhibitor 1 CASP9 caspase 9, apoptosis-XIAP X-linked inhibitor of related cysteine apoptosis peptidase GLG1 golgi glycoprotein 1 EPO erythropoietin VEGFA vascular endothelial ELN elastin growth factor A GDNF glial cell derived NFE2L$^2$ nuclear factor (erythroid-neurotrophic factor derived 2)-like 2 SLC6A3 solute carrier family 6 HSPA4 heat shock 70 kDa (neurotransmitter protein 4 transporter, dopamine), member 3 APOE apolipoprotein E PSMB8 proteasome (prosome, macropain) subunit, beta type, 8 DCTN1 dynactin 1 TIMP3 TIMP metallopeptidase inhibitor 3 KIFAP3 kinesin-associated SLC1A1 solute carrier family 1 protein 3 (neuronal/epithelial high affinity glutamate transporter, system Xag), member 1 SMN2 survival of motor neuron CCNC cyclin C 2, centromeric MPP4 membrane protein, STUB1 STIP1 homology and U-palmitoylated 4 box containing protein 1 ALS2 amyloid beta (A4) PRDX6 peroxiredoxin 6 precursor protein SYP synaptophysin CABIN1 calcineurin binding protein 1 CASP1 caspase 1, apoptosis-GART phosphoribosylglycinami related cysteine de formyltransferase, peptidase phosphoribosylglycinami de synthetase, phosphoribosylaminoimi dazole synthetase CDK5 cyclin-dependent kinase 5 ATXN3 ataxin 3 RTN4 reticulon 4 C1QB complement component 1, q subcomponent, β chain VEGFC nerve growth factor HTT huntingtin receptor PARK7 Parkinson disease 7 XDH xanthine dehydrogenase GFAP glial fibrillary acidic MAP2 microtubule-associated protein protein 2 CYCS cytochrome c, somatic FCGR3B Fc fragment of IgG, low affinity IIIb, CCS copper chaperone for UBL5 ubiquitin-like 5 superoxide dismutase MMP9 matrix metallopeptidase SLC18A3 solute carrier family 18 9 ((vesicular acetylcholine), member 3 TRPM7 transient receptor HSPB2 heat shock 27 kDa potential cation channel, protein 2 subfamily M, member 7 AKT1 v-akt murine thymoma DERL1 Derl-like domain family, viral oncogene homolog 1 member 1 CCL2 chemokine (C--C motif) NGRN neugrin, neurite ligand 2 outgrowth associated GSR glutathione reductase TPPP3 tubulin polymerization-promoting protein family member 3 APAF1 apoptotic peptidase BTBD10 BTB (POZ) domain activating factor 1 containing 10 GLUD1 glutamate CXCR4 chemokine (C-X--C motif) dehydrogenase 1 receptor 4 SLC1A3 solute carrier family 1 FLT1 fms-related tyrosine (glial high affinity glutamate transporter), member 3 kinase 1 PON1 paraoxonase 1 AR androgen receptor LIF leukemia inhibitory factor ERBB3 v-erb-b2 erythroblastic leukemia viral oncogene homolog 3 LGALS1 lectin, galactoside-CD44 CD44 molecule binding, soluble, 1 TP53 tumor protein p53 TLR3 toll-like receptor 3 GRIA1 glutamate receptor, GAPDH glyceraldehyde-3-ionotropic, AMPA 1 phosphate dehydrogenase GRIK1 glutamate receptor, DES desmin ionotropic, kainate 1 CHAT choline acetyltransferase FLT4 fms-related tyrosine kinase 4 CHMP2B chromatin modifying BAG1 BCL2-associated protein 2B athanogene MT3 metallothionein 3 CHRNA4 cholinergic receptor, nicotinic, alpha 4 GSS glutathione synthetase BAK1 BCL2-antagonist/killer 1 KDR kinase insert domain GSTP1 glutathione S-transferase receptor (a type III pi 1 receptor tyrosine kinase) OGG18-oxoguanine DNA IL6 interleukin 6 (interferon, glycosylase beta 2).

The animal or cell may comprise 1, 2, 3, 4, 5, 6, 7, 8, 9, 10 or more disrupted chromosomal sequences encoding a protein associated with ALS and zero, 1, 2, 3, 4, 5, 6, 7, 8, 9, 10 or more chromosomally integrated sequences encoding the disrupted protein associated with ALS. Preferred proteins associated with ALS include SOD1 (superoxide dismutase 1), ALS2 (amyotrophic lateral sclerosis 2), FUS (fused in sarcoma), TARDBP (TAR DNA binding protein), VAGFA (vascular endothelial growth factor A), VAGFB (vascular endothelial growth factor B), and VAGFC (vascular endothelial growth factor C), and any combination thereof.

Autism

US Patent Publication No. 20110023145, describes use of zinc finger nucleases to genetically modify cells, animals and proteins associated with autism spectrum disorders (ASD). Autism spectrum disorders (ASDs) are a group of disorders characterized by qualitative impairment in social interaction and communication, and restricted repetitive and stereotyped patterns of behavior, interests, and activities. The three disorders, autism, Asperger syndrome (AS) and pervasive developmental disorder-not otherwise specified (PDD-NOS) are a continuum of the same disorder with varying degrees of severity, associated intellectual functioning and medical conditions. ASDs are predominantly genetically determined disorders with a heritability of around 90%.

US Patent Publication No. 20110023145 comprises editing of any chromosomal sequences that encode proteins associated with ASD which may be applied to the CRISPR Cas system of the present invention. The proteins associated with ASD are typically selected based on an experimental association of the protein associated with ASD to an incidence or indication of an ASD. For example, the production rate or circulating concentration of a protein associated with ASD may be elevated or depressed in a population having an ASD relative to a population lacking the ASD. Differences in protein levels may be assessed using proteomic techniques including but not limited to Western blot, immunohistochemical staining, enzyme linked immunosorbent assay (ELISA), and mass spectrometry. Alternatively, the proteins associated with ASD may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non limiting examples of disease states or disorders that may be associated with proteins associated with ASD include autism, Asperger syndrome (AS), pervasive developmental disorder-not otherwise specified (PDD-NOS), Rett's syndrome, tuberous sclerosis, phenylketonuria, Smith-Lemli-Opitz syndrome and fragile X syndrome. By way of non-limiting example, proteins associated with ASD include but are not limited to the following proteins: ATP10C aminophospholipid-MET MET receptor transporting ATPase tyrosine kinase (ATP10C) BZRAP1 MGLUR5 (GRM5) Metabotropic glutamate receptor 5 (MGLUR5) CDH10 Cadherin-10 MGLUR6 (GRM6) Metabotropic glutamate receptor 6 (MGLUR6) CDH9 Cadherin-9 NLGN1 Neuroligin-1 CNTN4 Contactin-4 NLGN2 Neuroligin-2 CNTNAP2 Contactin-associated SEMASA Neuroligin-3 protein-like 2 (CNTNAP2) DHCR7 7-dehydrocholesterol NLGN4X Neuroligin-4 X-reductase (DHCR7) linked DOC2A Double $C_2$-like domain-NLGN4Y Neuroligin-4 Y-containing protein alpha linked DPP6 Dipeptidyl NLGN5 Neuroligin-5 aminopeptidase-like protein 6 EN2 engrailed 2 (EN2) NRCAM Neuronal cell adhesion molecule (NR-CAM) MDGA2 fragile X mental retardation NRXN1 Neurexin-1 1 (MDGA2) FMR2 (AFF2) AF4/FMR2 family member 2 OR4M2 Olfactory receptor (AFF2) 4M2 FOXP2 Forkhead box protein P2 OR4N4 Olfactory receptor (FOXP2) 4N4 FXR1 Fragile X mental OXTR oxytocin receptor retardation, autosomal (OXTR) homolog 1 (FXR1) FXR2 Fragile X mental PAH phenylalanine retardation, autosomal hydroxylase (PAH) homolog 2 (FXR2) GABRA1 Gamma-aminobutyric acid PTEN Phosphatase and receptor subunit alpha-1 tensin homologue (GABRA1) (PTEN) GABRA5 GABAA (.gamma.-aminobutyric PTPRZ 1 Receptor-type acid) receptor alpha 5 tyrosine-protein subunit (GABRA5) phosphatase zeta (PTPRZ1) GABRB1 Gamma-aminobutyric acid RELN Reelin receptor subunit beta-1 (GABRB1) GABRB3 GABAA (.gamma.-aminobutyric RPL10 60S ribosomal acid) receptor.beta.3 subunit protein L10 (GABRB3) GABRGI Gamma-aminobutyric acid SEMASA Semaphorin-5A receptor subunit gamma-1 (SEMA5A) (GABRGI) HIRIP3 HIRA-interacting protein 3 SEZ6L$^2$ seizure related 6 homolog (mouse)-like 2 HOXA1 Homeobox protein Hox-Al SHANK3 SH3 and multiple (HOXA1) ankyrin repeat domains 3 (SHANK3) IL6 Interleukin-6 SHBZRAP1 SH3 and multiple ankyrin repeat domains 3 (SHBZRAP1) LAMB1 Laminin subunit beta-1 SLC6A4 Serotonin (LAMB1) transporter (SERT) MAPK3 Mitogen-activated protein TAS2R1 Taste receptor kinase 3 type 2 member 1 TAS2R1 MAZ Myc-associated zinc finger TSC1 Tuberous sclerosis protein protein 1 MDGA2 MAM domain containing TSC2 Tuberous sclerosis glycosylphosphatidylinositol protein 2 anchor 2 (MDGA2) MECP2 Methyl CpG binding UBE3A Ubiquitin protein protein 2 (MECP2) ligase E3A (UBE3A) MECP2 methyl CpG binding WNT2 Wingless-type protein 2 (MECP2) MMTV integration site family, member 2 (WNT2)

The identity of the protein associated with ASD whose chromosomal sequence is edited can and will vary. In preferred embodiments, the proteins associated with ASD whose chromosomal sequence is edited may be the benzodiazapine receptor (peripheral) associated protein 1 (BZ-RAP1) encoded by the BZRAP1 gene, the AF4/FMR2 family member 2 protein (AFF2) encoded by the AFF2 gene (also termed MFR2), the fragile X mental retardation autosomal homolog 1 protein (FXR1) encoded by the FXR1 gene, the fragile X mental retardation autosomal homolog 2 protein (FXR2) encoded by the FXR2 gene, the MAM domain containing glycosylphosphatidylinositol anchor 2 protein (MDGA2) encoded by the MDGA2 gene, the methyl CpG binding protein 2 (MECP2) encoded by the MECP2 gene, the metabotropic glutamate receptor 5 (MGLUR5) encoded by the MGLUR5-1 gene (also termed GRM5), the neurexin 1 protein encoded by the NRXN1 gene, or the semaphorin-5A protein (SEMA5A) encoded by the SEMA5A gene. In an exemplary embodiment, the genetically modified animal is a rat, and the edited chromosomal sequence encoding the protein associated with ASD is as listed below: BZRAP1 benzodiazapine receptor XM_002727789, (peripheral) associated XM_213427, protein 1 (BZRAP1) XM_002724533, XM_001081125 AFF2 (FMR2) AF4/FMR2 family member 2 XM_219832, (AFF2) XM_001054673 FXR1 Fragile X mental NM_001012179 retardation, autosomal homolog 1 (FXR1) FXR2 Fragile X mental NM_001100647 retardation, autosomal homolog 2 (FXR2) MDGA2 MAM domain containing NM 199269 glycosylphosphatidylinositol anchor 2 (MDGA2) MECP2 Methyl CpG binding NM_022673 protein 2 (MECP2) MGLUR5 Metabotropic glutamate NM_017012 (GRM5) receptor 5 (MGLUR5) NRXN1 Neurexin-1 NM_021767 SEMA5A Semaphorin-5A (SEMA5A) NM_001107659.

Trinucleotide Repeat Expansion Disorders

US Patent Publication No. 20110016540, describes use of zinc finger nucleases to genetically modify cells, animals and proteins associated with trinucleotide repeat expansion disorders. Trinucleotide repeat expansion disorders are complex, progressive disorders that involve developmental neurobiology and often affect cognition as well as sensori-motor functions.

Trinucleotide repeat expansion proteins are a diverse set of proteins associated with susceptibility for developing a trinucleotide repeat expansion disorder, the presence of a trinucleotide repeat expansion disorder, the severity of a trinucleotide repeat expansion disorder or any combination thereof. Trinucleotide repeat expansion disorders are divided into two categories determined by the type of repeat. The most common repeat is the triplet CAG, which, when present in the coding region of a gene, codes for the amino acid glutamine (Q). Therefore, these disorders are referred to as the polyglutamine (polyQ) disorders and comprise the following diseases: Huntington Disease (HD); Spinobulbar Muscular Atrophy (SBMA); Spinocerebellar Ataxias (SCA types 1, 2, 3, 6, 7, and 17); and Dentatorubro-Pallidoluysian Atrophy (DRPLA). The remaining trinucleotide repeat expansion disorders either do not involve the CAG triplet or the CAG triplet is not in the coding region of the gene and are, therefore, referred to as the non-polyglutamine disorders. The non-polyglutamine disorders comprise Fragile X Syndrome (FRAXA); Fragile XE Mental Retardation (FRAXE); Friedreich Ataxia (FRDA); Myotonic Dystrophy (DM); and Spinocerebellar Ataxias (SCA types 8, and 12).

The proteins associated with trinucleotide repeat expansion disorders are typically selected based on an experimental association of the protein associated with a trinucleotide repeat expansion disorder to a trinucleotide repeat expansion disorder. For example, the production rate or circulating concentration of a protein associated with a trinucleotide repeat expansion disorder may be elevated or depressed in a population having a trinucleotide repeat expansion disorder relative to a population lacking the trinucleotide repeat expansion disorder. Differences in protein levels may be assessed using proteomic techniques including but not limited to Western blot, immunohistochemical staining, enzyme linked immunosorbent assay (ELISA), and mass spectrometry. Alternatively, the proteins associated with trinucleotide repeat expansion disorders may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

Non-limiting examples of proteins associated with trinucleotide repeat expansion disorders include AR (androgen receptor), FMR1 (fragile X mental retardation 1), HTT (huntingtin), DMPK (dystrophia myotonica-protein kinase), FXN (frataxin), ATXN2 (ataxin 2), ATN1 (atrophin 1), FEN1 (flap structure-specific endonuclease 1), TNRC6A (trinucleotide repeat containing 6A), PABPN1 (poly(A) binding protein, nuclear 1), JPH3 (junctophilin 3), MED15 (mediator complex subunit 15), ATXN1 (ataxin 1), ATXN3 (ataxin 3), TBP (TATA box binding protein), CACNA1A (calcium channel, voltage-dependent, P/Q type, alpha 1A subunit), ATXN80S (ATXN8 opposite strand (non-protein coding)), PPP2R2B (protein phosphatase 2, regulatory subunit B, beta), ATXN7 (ataxin 7), TNRC6B (trinucleotide repeat containing 6B), TNRC6C (trinucleotide repeat containing 6C), CELF3 (CUGBP, Elav-like family member 3), MAB21L$^1$ (mab-21-like 1 (*C. elegans*)), MSH2 (mutS homolog 2, colon cancer, nonpolyposis type 1 (*E. coli*)), TMEM185A (transmembrane protein 185A), SIX5 (SIX homeobox 5), CNPY3 (canopy 3 homolog (zebrafish)), FRAXE (fragile site, folic acid type, rare, fra(X)(q28) E), GNB2 (guanine nucleotide binding protein (G protein), beta polypeptide 2), RPL14 (ribosomal protein L$^{14}$), ATXN8 (ataxin 8), INSR (insulin receptor), TTR (transthyretin), EP400 (E1A binding protein p400), GIGYF2 (GRB10 interacting GYF protein 2), OGG1 (8-oxoguanine DNA glycosylase), STC1 (stanniocalcin 1), CNDP1 (carnosine dipeptidase 1 (metallopeptidase M20 family)), C10orf2 (chromosome 10 open reading frame 2), MAML3 (mastermind-like 3 (*Drosophila*)), DKC1 (dyskeratosis congenita 1, dyskerin), PAXIP1 (PAX interacting (with transcription-activation domain) protein 1), CASK (calcium/calmodulin-dependent serine protein kinase (MAGUK family)), MAPT (microtubule-associated protein tau), SPi (Spi transcription factor), POLG (polymerase (DNA directed), gamma), AFF2 (AF4/FMR2 family, member 2), THBS1 (thrombospondin 1), TP53 (tumor protein p53), ESR1 (estrogen receptor 1), CGGBP1 (CGG triplet repeat binding protein 1), ABT1 (activator of basal transcription 1), KLK3 (kallikrein-related peptidase 3), PRNP (prion protein), JUN (jun oncogene), KCNN3 (potassium intermediate/small conductance calcium-activated channel, subfamily N, member 3), BAX (BCL2-associated X protein), FRAXA (fragile site, folic acid type, rare, fra(X)(q27.3) A (macroorchidism, mental retardation)), KBTBD10 (kelch repeat and BTB (POZ) domain containing 10), MBNL1 (muscleblind-like (*Drosophila*)), RAD51 (RAD51 homolog (RecA homolog, *E. coli*) (*S. cerevisiae*)), NCOA3 (nuclear receptor coactivator 3), ERDA1 (expanded repeat domain, CAG/CTG 1), TSC1 (tuberous sclerosis 1), COMP (cartilage oligomeric matrix protein), GCLC (glutamate-cysteine ligase, catalytic subunit), RRAD (Ras-related associated with diabetes), MSH3 (mutS homolog 3 (*E. coli*)), DRD2 (dopamine receptor D2), CD44 (CD44 molecule (Indian blood group)), CTCF (CCCTC-binding factor (zinc finger protein)), CCND1 (cyclin D1), CLSPN (claspin homolog (*Xenopus laevis*)), MEF2A (myocyte enhancer factor 2A), PTPRU (protein tyrosine phosphatase, receptor type, U), GAPDH (glyceraldehyde-3-phosphate dehydrogenase), TRIM22 (tripartite motif-containing 22), WT1 (Wilms tumor 1), AHR (aryl hydrocarbon receptor), GPX1 (glutathione peroxidase 1), TPMT (thiopurine S-methyltransferase), NDP (Norrie disease (pseudoglioma)), ARX (aristaless related homeobox), MUS81 (MUS81 endonuclease homolog (*S. cerevisiae*)), TYR (tyrosinase (oculocutaneous albinism IA)), EGR1 (early growth response 1), UNG (uracil-DNA glycosylase), NUMBL (numb homolog (*Drosophila*)-like), FABP2 (fatty acid binding protein 2, intestinal), EN2 (engrailed homeobox 2), CRYGC (crystallin, gamma C), SRP14 (signal recognition particle 14 kDa (homologous Alu RNA binding protein)), CRYGB (crystallin, gamma B), PDCD1 (programmed cell death 1), HOXA1 (homeobox Al), ATXN2L (ataxin 2-like), PMS2 (PMS2 postmeiotic segregation increased 2 (*S. cerevisiae*)), GLA (galactosidase, alpha), CBL (Cas-Br-M (murine) ecotropic retroviral transforming sequence), FTH1 (ferritin, heavy polypeptide 1), IL12RB2 (interleukin 12 receptor, beta 2), OTX2 (orthodenticle homeobox 2), HOXA5 (homeobox A5), POLG2 (polymerase (DNA directed), gamma 2, accessory subunit), DLX2 (distal-less homeobox 2), SIRPA (signal-regulatory protein alpha), OTX1 (orthodenticle homeobox 1), AHRR (aryl-hydrocarbon receptor repressor), MANF (mesencephalic astrocyte-derived neurotrophic factor), TMEM158 (transmembrane protein 158 (gene/pseudogene)), and ENSG00000078687.

Preferred proteins associated with trinucleotide repeat expansion disorders include HTT (Huntingtin), AR (androgen receptor), FXN (frataxin), Atxn3 (ataxin), Atxn1 (ataxin), Atxn2 (ataxin), Atxn7 (ataxin), Atxn10 (ataxin), DMPK (dystrophia myotonica-protein kinase), AtnI (atrophin 1), CBP (creb binding protein), VLDLR (very low density lipoprotein receptor), and any combination thereof.

Treating Hearing Diseases

The present invention also contemplates delivering the CRISPR-Cas system to one or both ears.

Researchers are looking into whether gene therapy could be used to aid current deafness treatments—namely, cochlear implants. Deafness is often caused by lost or damaged hair cells that cannot relay signals to auditory neurons. In such cases, cochlear implants may be used to respond to sound and transmit electrical signals to the nerve cells. But these neurons often degenerate and retract from the cochlea as fewer growth factors are released by impaired hair cells.

US patent application 20120328580 describes injection of a pharmaceutical composition into the ear (e.g., auricular administration), such as into the luminae of the cochlea (e.g., the Scala media, Sc vestibulae, and Sc tympani), e.g., using a syringe, e.g., a single-dose syringe. For example, one or more of the compounds described herein can be administered by intratympanic injection (e.g., into the middle ear), and/or injections into the outer, middle, and/or inner ear. Such methods are routinely used in the art, for example, for the administration of steroids and antibiotics into human ears. Injection can be, for example, through the round window of the ear or through the cochlear capsule. Other inner ear administration methods are known in the art (see, e.g., Salt and Plontke, Drug Discovery Today, 10:1299-1306, 2005).

In another mode of administration, the pharmaceutical composition can be administered in situ, via a catheter or pump. A catheter or pump can, for example, direct a pharmaceutical composition into the cochlear luminae or the round window of the ear and/or the lumen of the colon. Exemplary drug delivery apparatus and methods suitable for administering one or more of the compounds described herein into an ear, e.g., a human ear, are described by McKenna et al., (U.S. Publication No. 2006/0030837) and Jacobsen et al., (U.S. Pat. No. 7,206,639). In some embodiments, a catheter or pump can be positioned, e.g., in the ear (e.g., the outer, middle, and/or inner ear) of a patient during a surgical procedure. In some embodiments, a catheter or pump can be positioned, e.g., in the ear (e.g., the outer, middle, and/or inner ear) of a patient without the need for a surgical procedure.

Alternatively or in addition, one or more of the compounds described herein can be administered in combination with a mechanical device such as a cochlear implant or a hearing aid, which is worn in the outer ear. An exemplary cochlear implant that is suitable for use with the present invention is described by Edge et al., (U.S. Publication No. 2007/0093878).

In some embodiments, the modes of administration described above may be combined in any order and can be simultaneous or interspersed.

Alternatively or in addition, the present invention may be administered according to any of the Food and Drug Administration approved methods, for example, as described in CDER Data Standards Manual, version number 004 (which is available at fda.give/cder/dsm/DRG/drg00301.htm).

In general, the cell therapy methods described in US patent application 20120328580 can be used to promote complete or partial differentiation of a cell to or towards a mature cell type of the inner ear (e.g., a hair cell) in vitro. Cells resulting from such methods can then be transplanted or implanted into a patient in need of such treatment. The cell culture methods required to practice these methods, including methods for identifying and selecting suitable cell types, methods for promoting complete or partial differentiation of selected cells, methods for identifying complete or partially differentiated cell types, and methods for implanting complete or partially differentiated cells are described below.

Cells suitable for use in the present invention include, but are not limited to, cells that are capable of differentiating completely or partially into a mature cell of the inner ear, e.g., a hair cell (e.g., an inner and/or outer hair cell), when contacted, e.g., in vitro, with one or more of the compounds described herein. Exemplary cells that are capable of differentiating into a hair cell include, but are not limited to stem cells (e.g., inner ear stem cells, adult stem cells, bone marrow derived stem cells, embryonic stem cells, mesenchymal stem cells, skin stem cells, iPS cells, and fat derived stem cells), progenitor cells (e.g., inner ear progenitor cells), support cells (e.g., Deiters' cells, pillar cells, inner phalangeal cells, tectal cells and Hensen's cells), and/or germ cells. The use of stem cells for the replacement of inner ear sensory cells is described in L$^1$ et al., (U.S. Publication No. 2005/0287127) and L$^1$ et al., (U.S. patent Ser. No. 11/953, 797). The use of bone marrow derived stem cells for the replacement of inner ear sensory cells is described in Edge et al., PCT/US2007/084654. iPS cells are described, e.g., at Takahashi et al., Cell, Volume 131, Issue 5, Pages 861-872 (2007); Takahashi and Yamanaka, Cell 126, 663-76 (2006); Okita et al., Nature 448, 260-262 (2007); Yu, J. et al., Science 318(5858):1917-1920 (2007); Nakagawa et al., Nat. Biotechnol. 26:101-10$^6$ (2008); and Zaehres and Scholer, Cell 131(5):834-835 (2007). Such suitable cells can be identified by analyzing (e.g., qualitatively or quantitatively) the presence of one or more tissue specific genes. For example, gene expression can be detected by detecting the protein product of one or more tissue-specific genes. Protein detection techniques involve staining proteins (e.g., using cell extracts or whole cells) using antibodies against the appropriate antigen. In this case, the appropriate antigen is the protein product of the tissue-specific gene expression. Although, in principle, a first antibody (i.e., the antibody that binds the antigen) can be labeled, it is more common (and improves the visualization) to use a second antibody directed against the first (e.g., an anti-IgG). This second antibody is conjugated either with fluorochromes, or appropriate enzymes for colorimetric reactions, or gold beads (for electron microscopy), or with the biotin-avidin system, so that the location of the primary antibody, and thus the antigen, can be recognized.

The CRISPR Cas molecules of the present invention may be delivered to the ear by direct application of pharmaceutical composition to the outer ear, with compositions modified from US Published application, 20110142917. In some embodiments the pharmaceutical composition is applied to the ear canal. Delivery to the ear may also be referred to as aural or otic delivery.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Qi et al. discloses methods for efficient siRNA transfection to the inner ear through the intact round window by a novel proteidic delivery technology which may be applied to the nucleic acid-targeting system of the present invention (see, e.g., Qi et al., Gene Therapy (2013), 1-9). In particular, a TAT double stranded RNA-binding domains (TAT-DRBDs), which can transfect Cy3-labeled siRNA into cells of the inner ear, including the inner and outer hair cells, crista ampullaris, macula utriculi and macula sacculi, through intact round-window permeation was successful for delivering double stranded siRNAs in vivo for treating various inner ear ailments and preservation of hearing function. About 40 µl of 10 mM RNA may be contemplated as the dosage for administration to the ear.

According to Rejali et al. (Hear Res. 2007 June;228(1-2):180-7), cochlear implant function can be improved by good preservation of the spiral ganglion neurons, which are the target of electrical stimulation by the implant and brain derived neurotrophic factor (BDNF) has previously been shown to enhance spiral ganglion survival in experimentally deafened ears. Rejali et al. tested a modified design of the cochlear implant electrode that includes a coating of fibroblast cells transduced by a viral vector with a BDNF gene insert. To accomplish this type of ex vivo gene transfer, Rejali et al. transduced guinea pig fibroblasts with an adenovirus with a BDNF gene cassette insert, and determined that these cells secreted BDNF and then attached BDNF-secreting cells to the cochlear implant electrode via an agarose gel, and implanted the electrode in the scala tympani. Rejali et al. determined that the BDNF expressing electrodes were able to preserve significantly more spiral ganglion neurons in the basal turns of the cochlea after 48 days of implantation when compared to control electrodes and demonstrated the feasibility of combining cochlear implant therapy with ex vivo gene transfer for enhancing spiral ganglion neuron survival. Such a system may be applied to the nucleic acid-targeting system of the present invention for delivery to the ear.

Mukherjea et al. (Antioxidants & Redox Signaling, Volume 13, Number 5, 2010) document that knockdown of NOX3 using short interfering (si) RNA abrogated cisplatin ototoxicity, as evidenced by protection of OHCs from damage and reduced threshold shifts in auditory brainstem responses (ABRs). Different doses of siNOX3 (0.3, 0.6, and 0.9 g) were administered to rats and NOX3 expression was evaluated by real time RT-PCR. The lowest dose of NOX3 siRNA used (0.3 g) did not show any inhibition of NOX3 mRNA when compared to transtympanic administration of scrambled siRNA or untreated *cochleae*. However, administration of the higher doses of NOX3 siRNA (0.6 and 0.9 g) reduced NOX3 expression compared to control scrambled siRNA. Such a system may be applied to the CRISPR Cas system of the present invention for transtympanic administration with a dosage of about 2 mg to about 4 mg of CRISPR Cas for administration to a human.

Jung et al. (Molecular Therapy, vol. 21 no. 4, 834-841 April 2013) demonstrate that Hes5 levels in the utricle decreased after the application of siRNA and that the number of hair cells in these utricles was significantly larger than following control treatment. The data suggest that siRNA technology may be useful for inducing repair and regeneration in the inner ear and that the Notch signaling pathway is a potentially useful target for specific gene expression inhibition. Jung et al. injected 8 g of Hes5 siRNA in 2 µl volume, prepared by adding sterile normal saline to the lyophilized siRNA to a vestibular epithelium of the ear. Such a system may be applied to the nucleic acid-targeting system of the present invention for administration to the vestibular epithelium of the ear with a dosage of about 1 to about 30 mg of CRISPR Cas for administration to a human.

Gene Targeting in Non-Dividing Cells (Neurones & Muscle)

Non-dividing (especially non-dividing, fully differentiated) cell types present issues for gene targeting or genome engineering, for example because homologous recombination (HR) is generally suppressed in the G1 cell-cycle phase. However, while studying the mechanisms by which cells control normal DNA repair systems, Durocher discovered a previously unknown switch that keeps HR "off" in non-dividing cells and devised a strategy to toggle this switch back on. Orthwein et al. (Daniel Durocher's lab at the Mount Sinai Hospital in Ottawa, Canada) recently reported (Nature 16142, published online 9 Dec. 2015) have shown that the suppression of HR can be lifted and gene targeting successfully concluded in both kidney (293T) and osteosarcoma (U20S) cells. Tumor suppressors, BRCA1, PALB2 and BRAC2 are known to promote DNA DSB repair by HR. They found that formation of a complex of BRCA1 with PALB2-BRAC2 is governed by a ubiquitin site on PALB2, such that action on the site by an E3 ubiquitin ligase. This E3 ubiquitin ligase is composed of KEAP1 (a PALB2-interacting protein) in complex with cullin-3 (CUL3)-RBX1. PALB2 ubiquitylation suppresses its interaction with BRCA1 and is counteracted by the deubiquitylase USP11, which is itself under cell cycle control. Restoration of the BRCA1-PALB2 interaction combined with the activation of DNA-end resection is sufficient to induce homologous recombination in G1, as measured by a number of methods including a CRISPR-Cas9-based gene-targeting assay directed at USP11 or KEAP1 (expressed from a pX459 vector). However, when the BRCA1-PALB2 interaction was restored in resection-competent G1 cells using either KEAP1 depletion or expression of the PALB2-KR mutant, a robust increase in gene-targeting events was detected.

Thus, reactivation of HR in cells, especially non-dividing, fully differentiated cell types is preferred, in some embodiments. In some embodiments, promotion of the BRCA1-PALB2 interaction is preferred in some embodiments. In some embodiments, the target ell is a non-dividing cell. In some embodiments, the target cell is a neurone or muscle cell. In some embodiments, the target cell is targeted in vivo. In some embodiments, the cell is in G1 and HR is suppressed. In some embodiments, use of KEAP1 depletion, for example inhibition of expression of KEAP1 activity, is preferred. KEAP1 depletion may be achieved through siRNA, for example as shown in Orthwein et al. Alternatively, expression of the PALB2-KR mutant (lacking all eight Lys residues in the BRCA1-interaction domain is preferred, either in combination with KEAP1 depletion or alone. PALB2-KR interacts with BRCA1 irrespective of cell cycle position. Thus, promotion or restoration of the BRCA1-PALB2 interaction, especially in G1 cells, is preferred in some embodiments, especially where the target cells are non-dividing, or where removal and return (ex vivo gene targeting) is problematic, for example neurone or muscle cells. KEAP1 siRNA is available from ThermoFischer. In some embodiments, a BRCA1-PALB2 complex may be delivered to the G1 cell. In some embodiments, PALB2 deubiquitylation may be promoted for example by increased expression of the deubiquitylase USP 11, so it is envisaged that a construct may be provided to promote or up-regulate expression or activity of the deubiquitylase USPi11.

Treating Diseases of the Eye

The present invention also contemplates delivering the CRISPR-Cas system to one or both eyes.

In particular embodiments of the invention, the CRISPR-Cas system may be used to correct ocular defects that arise from several genetic mutations further described in Genetic Diseases of the Eye, Second Edition, edited by Elias I. Traboulsi, Oxford University Press, 2012.

In some embodiments, the condition to be treated or targeted is an eye disorder. In some embodiments, the eye disorder may include glaucoma. In some embodiments, the eye disorder includes a retinal degenerative disease. In some embodiments, the retinal degenerative disease is selected from Stargardt disease, Bardet-Biedl Syndrome, Best disease, Blue Cone Monochromacy, Choroidermia, Cone-rod dystrophy, Congenital Stationary Night Blindness, Enhanced S-Cone Syndrome, Juvenile X-Linked Retinoschisis, Leber Congenital Amaurosis, Malattia Leventinesse, Norrie Disease or X-linked Familial Exudative Vitreoretinopathy, Pattern Dystrophy, Sorsby Dystrophy, Usher Syndrome, Retinitis Pigmentosa, Achromatopsia or Macular dystrophies or degeneration, Retinitis Pigmentosa, Achromatopsia, and age related macular degeneration. In some embodiments, the retinal degenerative disease is Leber Congenital Amaurosis (LCA) or Retinitis Pigmentosa. In some embodiments, the CRISPR system is delivered to the eye, optionally via intravitreal injection or subretinal injection.

For administration to the eye, lentiviral vectors, in particular equine infectious anemia viruses (EIAV) are particularly preferred.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285, Published online 21 Nov. 2005 in Wiley InterScience (www.interscience.wiley.com). DOI: 10.1002/jgm.845). The vectors are contemplated to have cytomegalovirus (CMV) promoter driving expression of the target gene. Intracameral, subretinal, intraocular and intravitreal injections are all contemplated (see, e.g., Balagaan, J Gene Med 2006; 8: 275-285, Published online 21 Nov. 2005 in Wiley InterScience (www.interscience.wiley.com). DOI: 10.1002/jgm.845). Intraocular injections may be performed with the aid of an operating microscope. For subretinal and intravitreal injections, eyes may be prolapsed by gentle digital pressure and fundi visualised using a contact lens system consisting of a drop of a coupling medium solution on the cornea covered with a glass microscope slide coverslip. For subretinal injections, the tip of a 10-mm 34-gauge needle, mounted on a 5-µl Hamilton syringe may be advanced under direct visualisation through the superior equatorial sclera tangentially towards the posterior pole until the aperture of the needle was visible in the subretinal space. Then, 2 µl of vector suspension may be injected to produce a superior bullous retinal detachment, thus confirming subretinal vector administration. This approach creates a self-sealing sclerotomy allowing the vector suspension to be retained in the subretinal space until it is absorbed by the RPE, usually within 48 h of the procedure. This procedure may be repeated in the inferior hemisphere to produce an inferior retinal detachment. This technique results in the exposure of approximately 70% of neurosensory retina and RPE to the vector suspension. For intravitreal injections, the needle tip may be advanced through the sclera 1 mm posterior to the corneoscleral limbus and 2 µl of vector suspension injected into the vitreous cavity. For intracameral injections, the needle tip may be advanced through a corneoscleral limbal paracentesis, directed towards the central cornea, and 2 µl of vector suspension may be injected. For intracameral injections, the needle tip may be advanced through a corneoscleral limbal paracentesis, directed towards the central cornea, and 2 µl of vector suspension may be injected. These vectors may be injected at titres of either $1.0\text{-}1.4\times10^{10}$ or $1.0\text{-}1.4\times10^{9}$ transducing units (TU)/ml.

In another embodiment, RetinoStat®, an equine infectious anemia virus-based lentiviral gene therapy vector that expresses angiostatic proteins endostain and angiostatin that is delivered via a subretinal injection for the treatment of the web form of age-related macular degeneration is also contemplated (see, e.g., Binley et al., HUMAN GENE THERAPY 23:980-991 (September 2012)). Such a vector may be modified for the CRISPR-Cas system of the present invention. Each eye may be treated with either RetinoStat® at a dose of $1.1\times10^{1}$ transducing units per eye (TU/eye) in a total volume of 100 l.

In another embodiment, an E1-, partial E3-, E4-deleted adenoviral vector may be contemplated for delivery to the eye. Twenty-eight patients with advanced neovascular agerelated macular degeneration (AMD) were given a single intravitreous injection of an E1-, partial E3-, E4-deleted adenoviral vector expressing human pigment ep-ithelium-derived factor (AdPEDF.ll) (see, e.g., Campochiaro et al., Human Gene Therapy 17:167-176 (February 2006)). Doses ranging from $10^6$ to $10^{9.5}$ particle units (PU) were investigated and there were no serious adverse events related to AdPEDF.ll and no dose-limiting toxicities (see, e.g., Campochiaro et al., Human Gene Therapy 17:167-176 (February 2006)). Adenoviral vectormediated ocular gene transfer appears to be a viable approach for the treatment of ocular disorders and could be applied to the CRISPR Cas system.

In another embodiment, the sd-rxRNA® system of R×i Pharmaceuticals may be used/and or adapted for delivering CRISPR Cas to the eye. In this system, a single intravitreal administration of 3 g of sd-rxRNA results in sequence-specific reduction of PPIB mRNA levels for 14 days. The the sd-rxRNA® system may be applied to the nucleic acid-targeting system of the present invention, contemplating a dose of about 3 to 20 mg of CRISPR administered to a human.

Millington-Ward et al. (Molecular Therapy, vol. 19 no. 4, 642-649 April 2011) describes adeno-associated virus (AAV) vectors to deliver an RNA interference (RNAi)-based rhodopsin suppressor and a codon-modified rhodopsin replacement gene resistant to suppression due to nucleotide alterations at degenerate positions over the RNAi target site. An injection of either $6.0\times10^{8}$ vp or $1.8\times10^{10}$ vp AAV were subretinally injected into the eyes by Millington-Ward et al. The AAV vectors of Millington-Ward et al. may be applied to the CRISPR Cas system of the present invention, contemplating a dose of about $2\times10^{11}$ to about $6\times10^{13}$ vp administered to a human.

Dalkara et al. (Sci Transl Med 5, 189ra76 (2013)) also relates to in vivo directed evolution to fashion an AAV vector that delivers wild-type versions of defective genes throughout the retina after noninjurious injection into the eyes' vitreous humor. Dalkara describes a a 7mer peptide display library and an AAV library constructed by DNA shuffling of cap genes from AAV1, 2, 4, 5, 6, 8, and 9. The rcAAV libraries and rAAV vectors expressing GFP under a CAG or Rho promoter were packaged and and deoxyribonuclease-resistant genomic titers were obtained through quantitative PCR. The libraries were pooled, and two rounds of evolution were performed, each consisting of initial library diversification followed by three in vivo selection steps. In each such step, P30 rho-GFP mice were intravitreally injected with 2 ml of iodixanol-purified, phosphate-buffered saline (PBS)-dialyzed library with a genomic titer of about 1×1012 vg/ml. The AAV vectors of Dalkara et al. may be applied to the nucleic acid-targeting system of the present invention, contemplating a dose of about $1 \times 10^{15}$ to about $1 \times 10^{16}$ vg/ml administered to a human.

In a particular embodiment, the rhodopsin gene may be targeted for the treatment of retinitis pigmentosa (RP), wherein the system of US Patent Publication No. 20120204282 assigned to Sangamo BioSciences, Inc. may be modified in accordance with the CRISPR Cas system of the present invention.

In another embodiment, the methods of US Patent Publication No. 20130183282 assigned to Cellectis, which is directed to methods of cleaving a target sequence from the human rhodopsin gene, may also be modified to the nucleic acid-targeting system of the present invention.

US Patent Publication No. 20130202678 assigned to Academia *Sinica* relates to methods for treating retinopathies and sight-threatening ophthalmologic disorders relating to delivering of the Puf-A gene (which is expressed in retinal ganglion and pigmented cells of eye tissues and displays a unique anti-apoptotic activity) to the sub-retinal or intravitreal space in the eye. In particular, desirable targets are zgc:193933, prdmla, spata2, tex10, rbb4, ddx3, zp2.2, Blimp-1 and HtrA2, all of which may be targeted by the nucleic acid-targeting system of the present invention.

Wu (Cell Stem Cell,13:659-62, 2013) designed a guide RNA that led Cas9 to a single base pair mutation that causes cataracts in mice, where it induced DNA cleavage. Then using either the other wild-type allele or oligos given to the zygotes repair mechanisms corrected the sequence of the broken allele and corrected the cataract-causing genetic defect in mutant mouse.

US Patent Publication No. 20120159653, describes use of zinc finger nucleases to genetically modify cells, animals and proteins associated with macular degeration (MD). Macular degeneration (MD) is the primary cause of visual impairment in the elderly, but is also a hallmark symptom of childhood diseases such as Stargardt disease, Sorsby fundus, and fatal childhood neurodegenerative diseases, with an age of onset as young as infancy. Macular degeneration results in a loss of vision in the center of the visual field (the macula) because of damage to the retina. Currently existing animal models do not recapitulate major hallmarks of the disease as it is observed in humans. The available animal models comprising mutant genes encoding proteins associated with MD also produce highly variable phenotypes, making translations to human disease and therapy development problematic.

One aspect of US Patent Publication No. 20120159653 relates to editing of any chromosomal sequences that encode proteins associated with MD which may be applied to the nucleic acid-targeting system of the present invention. The proteins associated with MD are typically selected based on an experimental association of the protein associated with MD to an MD disorder. For example, the production rate or circulating concentration of a protein associated with MD may be elevated or depressed in a population having an MD disorder relative to a population lacking the MD disorder. Differences in protein levels may be assessed using proteomic techniques including but not limited to Western blot, immunohistochemical staining, enzyme linked immunosorbent assay (ELISA), and mass spectrometry. Alternatively, the proteins associated with MD may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of non-limiting example, proteins associated with MD include but are not limited to the following proteins: (ABCA4) ATP-binding cassette, sub-family A (ABC1), member 4 ACHM1 achromatopsia (rod monochromacy) 1 ApoE Apolipoprotein E (ApoE) $C_1$QTNF5 (CTRP5) C1q and tumor necrosis factor related protein 5 (ClQTNF5) $C_2$ Complement component 2 ($C_2$) $C_3$ Complement components ($C_3$) CCL2 Chemokine (C-C motif) Ligand 2 (CCL2) CCR2 Chemokine (C-C motif) receptor 2 (CCR2) CD36 Cluster of Differentiation 36 CFB Complement factor B CFH Complement factor CFH H CFHR1 complement factor H-related 1 CFHR3 complement factor H-related 3 CNGB3 cyclic nucleotide gated channel beta 3 CP ceruloplasmin (CP) CRP C reactive protein (CRP) CST3 cystatin C or cystatin 3 (CST3) CTSD Cathepsin D (CTSD) CX3CR1 chemokine (C-X3-C motif) receptor 1 ELOVL4 Elongation of very long chain fatty acids 4 ERCC6 excision repair crosscomplementing rodent repair deficiency, complementation group 6 FBLN5 Fibulin-5 FBLN5 Fibulin 5 FBLN6 Fibulin 6 FSCN2 fascin (FSCN2) HMCN1 Hemicentrin 1 HMCN1 hemicentin 1 HTRA1 HtrA serine peptidase 1 (HTRA1) HTRA1 HtrA serine peptidase 1 IL-6 Interleukin 6 IL-8 Interleukin 8 LOC387715 Hypothetical protein PLEKHA1 Pleckstrin homology domain containing family A member 1 (PLEKHA1) PROM1 Prominin 1(PROM1 or CD133) PRPH2 Peripherin-2 RPGR retinitis pigmentosa GTPase regulator SERPING1 serpin peptidase inhibitor, clade G, member 1 ($C_1$-inhibitor) TCOF1 Treacle TIMP3 Metalloproteinase inhibitor 3 (TIMP3) TLR3 Toll-like receptor 3.

The identity of the protein associated with MD whose chromosomal sequence is edited can and will vary. In preferred embodiments, the proteins associated with MD whose chromosomal sequence is edited may be the ATP-binding cassette, sub-family A (ABC1) member 4 protein (ABCA4) encoded by the ABCR gene, the apolipoprotein E protein (APOE) encoded by the APOE gene, the chemokine (C-C motif) Ligand 2 protein (CCL2) encoded by the CCL2 gene, the chemokine (C-C motif) receptor 2 protein (CCR2) encoded by the CCR2 gene, the ceruloplasmin protein (CP) encoded by the CP gene, the cathepsin D protein (CTSD) encoded by the CTSD gene, or the metalloproteinase inhibitor 3 protein (TIMP3) encoded by the TIMP3 gene. In an exemplary embodiment, the genetically modified animal is a rat, and the edited chromosomal sequence encoding the protein associated with MD may be: (ABCA4) ATPbinding cassette, NM_000350 sub-family A (ABC1), member 4 APOE Apolipoprotein E NM_138828 (APOE) CCL2 Chemokine (C-C NM_031530 motif) Ligand 2 (CCL2) CCR2 Chemokine (C-C NM_021866 motif) receptor 2

(CCR2) CP ceruloplasmin (CP) NM 012532 CTSD Cathepsin D (CTSD) NM_134334 TIMP3 Metalloproteinase NM_012886 inhibitor 3 (TIMP3) The animal or cell may comprise 1, 2, 3, 4, 5, 6, 7 or more disrupted chromosomal sequences encoding a protein associated with MD and zero, 1, 2, 3, 4, 5, 6, 7 or more chromosomally integrated sequences encoding the disrupted protein associated with MD.

The edited or integrated chromosomal sequence may be modified to encode an altered protein associated with MD. Several mutations in MD-related chromosomal sequences have been associated with MD. Non-limiting examples of mutations in chromosomal sequences associated with MD include those that may cause MD including in the ABCR protein, E471K (i.e. glutamate at position 471 is changed to lysine), R1 129L (i.e. arginine at position 1129 is changed to leucine), T1428M (i.e. threonine at position 1428 is changed to methionine), R1517S (i.e. arginine at position 1517 is changed to serine), 11562T (i.e. isoleucine at position 1562 is changed to threonine), and G1578R (i.e. glycine at position 1578 is changed to arginine); in the CCR2 protein, V64I (i.e. valine at position 192 is changed to isoleucine); in CP protein, G969B (i.e. glycine at position 969 is changed to asparagine or aspartate); in TIMP3 protein, S156C (i.e. serine at position 156 is changed to cysteine), G166C (i.e. glycine at position 166 is changed to cysteine), G167C (i.e. glycine at position 167 is changed to cysteine), Y168C (i.e. tyrosine at position 168 is changed to cysteine), S170C (i.e. serine at position 170 is changed to cysteine), Y172C (i.e. tyrosine at position 172 is changed to cysteine) and S181C (i.e. serine at position 181 is changed to cysteine). Other associations of genetic variants in MD-associated genes and disease are known in the art.

CRISPR systems are useful to correct diseases resulting from autosomal dominant genes. For example, CRISPR/Cas9 was used to remove an autosomal dominant gene that causes receptor loss in the eye. Bakondi, B. et al., In Vivo CRISPR Cas9 Gene Editing Corrects Retinal Dystrophy in the S334ter-3 Rat Model of Autosomal Dominant Retinitis Pigmentosa. Molecular Therapy, 2015; DOI: 10.1038/mt.2015.220.

Treating Circulatory and Muscular Diseases

The present invention also contemplates delivering the CRISPR-Cas system described herein, e.g. Cpf1 effector protein systems, to the heart. For the heart, a myocardium tropic adena-associated virus (AAVM) is preferred, in particular AAVM41 which showed preferential gene transfer in the heart (see, e.g., Lin-Yanga et al., PNAS, Mar. 10, 2009, vol. $10^6$, no. 10). Administration may be systemic or local. A dosage of about $1\text{-}10\times10^{14}$ vector genomes is contemplated for systemic administration. See also, e.g., Eulalio et al. (2012) Nature 492: 376 and Somasuntharam et al. (2013) Biomaterials 34: 7790.

For example, US Patent Publication No. 20110023139, describes use of zinc finger nucleases to genetically modify cells, animals and proteins associated with cardiovascular disease. Cardiovascular diseases generally include high blood pressure, heart attacks, heart failure, and stroke and TIA. Any chromosomal sequence involved in cardiovascular disease or the protein encoded by any chromosomal sequence involved in cardiovascular disease may be utilized in the methods described in this disclosure. The cardiovascular-related proteins are typically selected based on an experimental association of the cardiovascular-related protein to the development of cardiovascular disease. For example, the production rate or circulating concentration of a cardiovascular-related protein may be elevated or depressed in a population having a cardiovascular disorder relative to a population lacking the cardiovascular disorder. Differences in protein levels may be assessed using proteomic techniques including but not limited to Western blot, immunohistochemical staining, enzyme linked immunosorbent assay (ELISA), and mass spectrometry. Alternatively, the cardiovascular-related proteins may be identified by obtaining gene expression profiles of the genes encoding the proteins using genomic techniques including but not limited to DNA microarray analysis, serial analysis of gene expression (SAGE), and quantitative real-time polymerase chain reaction (Q-PCR).

By way of example, the chromosomal sequence may comprise, but is not limited to, IL1B (interleukin 1, beta), XDH (xanthine dehydrogenase), TP53 (tumor protein p53), PTGIS (prostaglandin 12 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin 12 (prostacyclin) receptor (IP)), KCNJ11 (potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPN5 (calpain 5), PARP14 (poly (ADP-ribose) polymerase family, member 14), MEX3C (mex-3 homolog C (*C. elegans*)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, $C_1Q$ and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C-C motif) ligand 2), LPL (lipoprotein lipase), VWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3 (coagulation factor III (thromboplastin, tissue factor)), CST3 (cystatin C), COG2 (component of oligomeric golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK1 (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein 111a, antigen CD61)), CAT (catalase), UTS2 (urotensin 2), THBD (thrombomodulin), F10 (coagulation factor X), CP (ceruloplasmin (ferroxidase)), TNFRSF11 B (tumor necrosis factor receptor superfamily, member 11b), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, subfamily B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C-C motif) receptor 5), MMP 1 (matrix metallopeptidase 1 (interstitial collagenase)), TIMP1 (TIMP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysin 1, progelatinase)), ELN (elastin), USF 1 (upstream transcription factor 1), CFH (complement factor H), HSPA4 (heat shock 70 kDa protein 4), MMP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-I-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C-X-C motif) receptor 4), PROC (protein C (inactivator of coagulation factors Va and VIIIa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid Al), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomerase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CABINI (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SPi (Spi transcription factor), TGIFi (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), IL2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member Al), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IL17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, Al polypeptide), TTR (transthyretin), FABP4 (fatty acid binding protein 4, adipocyte), PON3 (paraoxonase 3), APOC1 (apolipoprotein C-I), INSR (insulin receptor), TNFRSF 1B (tumor necrosis factor receptor superfamily, member 1), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L$^2$ (transcription factor 7-like 2 (T-cell specific, HMG-box)), BDKRB2 (bradykinin receptor B2), NFE2L$^2$ (nuclear factor (erythroid-derived 2)-like 2), NOTCH1 (Notch homolog 1, translocation-associated (Drosophila)), UGT1A1 (UDP glucuronosyltransferase 1 family, polypeptide Al), IFNA1 (interferon, alpha 1), PPARD (peroxisome proliferator-activated receptor delta), SIRT1 (sirtuin (silent mating type information regulation 2 homolog) 1 (S. cerevisiae)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT1 (glutathione S-transferase theta 1), IL6ST (interleukin 6 signal transducer (gp130, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member Al (aldehyde reductase)), ALDH9A1 (aldehyde dehydrogenase 9 family, member Al), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C$_4$B (complement component 4B (Chido blood group), P2RYl2 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C$_3$ botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMPP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin L$^1$), PCNA (proliferating cell nuclear antigen), IGF2 (insulin-like growth factor 2 (somatomedin A)), ITGB1 (integrin, beta 1 (fibronectin receptor, beta polypeptide, antigen CD29 includes MDF2, MSK12)), CAST (calpastatin), CXCL12 (chemokine (C-X-C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), IL2RA (interleukin 2 receptor, alpha), CCL5 (chemokine (C-C motif) ligand 5), IRF1 (interferon regulatory factor 1), CFLAR (CASP8 and FADD-like apoptosis regulator), CALCA (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C-C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PECAM1 (platelet/endothelial cell adhesion molecule), CCL4 (chemokine (C-C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L$^1$ (YME1-like 1 (S. cerevisiae)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-.beta.-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C-C motif) ligand 11), PGF (B321 placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Shal-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene $C_4$ synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHC1 (SHC (Src homology 2 domain containing) transforming protein 1), LRP1 (low density lipoprotein receptor-related protein 1), SOCS3 (suppressor of cytokine signaling 3), ADH1B (alcohol dehydrogenase 1B (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity 111a, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor H1), NR1I2 (nuclear receptor subfamily 1, group I, member 2), CRH (corticotropin releasing hormone), HTR1A (5-hydroxytryptamine (serotonin) receptor 1A), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity IIa, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), $C_4$BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C-X-C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F11 (coagulation factor XI), ATP7A (ATPase, Cu++ transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCHE (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C-X-C motif) receptor 3), CD81 (CD81 molecule), SMAD7 (SMAD family member 7), LAMC2 (laminin, gamma 2), MAP3K5 (mitogen-activated protein kinase kinase 5), CHGA (chromogranin A (parathyroid secretory protein 1)), IAPP (islet amyloid polypeptide), RHO (rhodopsin), ENPP1 (ectonucleotide pyrophosphatase/phosphodiesterase 1), PTHLH (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha-), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISH (cytokine inducible SH2-containing protein), GAST (gastrin), MYOC (myocilin, trabecular meshwork inducible glucocorticoid response), ATP1A2 (ATPase, Na+/K+ transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), HSF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTH (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOH (apolipoprotein H (beta-2-glycoprotein I)), S100A8 (S100 calcium binding protein A8), IL11 (interleukin 11), ALOX15 (arachidonate 15-lipoxygenase), FBLN1 (fibulin 1), NR1H3 (nuclear receptor subfamily 1, group H, member 3), SCD (stearoyl-CoA desaturase (delta- 9-desaturase)), GIP (gastric inhibitory polypeptide), CHGB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), HSD11B2 (hydroxysteroid (11-beta) dehydrogenase 2), CALCRL (calcitonin receptor-like), GALNT2 (UDP-N-acetyl-alpha-D-galactosamine.polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adenovirus E1B 19 kDa interacting protein 3), GCKR (glucokinase (hexokinase 4) regulator), S100A12 (S100 calcium binding protein A12), PADI4 (peptidyl arginine deiminase, type IV), HSPA14 (heat shock 70 kDa protein 14), CXCR1 (chemokine (C-X-C motif) receptor 1), H19 (H19, imprinted maternally expressed transcript (non-protein coding)), KRTAP19-3 (keratin associated protein 19-3), IDDM2 (insulin-dependent diabetes mellitus 2), RAC2 (ras-related $C_3$ botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNA1C (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11A (tumor necrosis factor receptor superfamily, member 11a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol(myo)-1(or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L1 (chitinase 3-like 1 (cartilage glycoprotein-39)), ALDH1B1 (aldehyde dehydrogenase 1 family, member Bi), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C-C motif) receptor 6), GJB3 (gap junction protein, beta 3, 31 kDa), IL1RL1 (interleukin 1 receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, Drosophila)), F 11R (F 11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), KHK (ketohexokinase (fructokinase)), SAT 1(spermidine/spermine N1-acetyltransferase 1), GGH (gamma-glutamyl hydrolase (conjugase, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RHOB (ras homolog gene family, member B), LY96 (lymphocyte antigen 96), FOXO1 (forkhead box 01), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (Drosophila)), PBX4 (pre-B-cell leukemia homeobox 4), NUPR1 (nuclear protein, transcriptional regulator, 1), 15-September(15 kDa selenoprotein), CILP2 (cartilage intermediate layer protein 2), TERC (telomerase RNA component), GGT2 (gamma-glutamyltransferase 2), MT-CO1 (mitochondrially encoded cytochrome c oxidase I), and UOX (urate oxidase, pseudogene). Any of these sequences, may be a target for the CRISPR-Cas system, e.g., to address mutation.

In an additional embodiment, the chromosomal sequence may further be selected from Pon1 (paraoxonase 1), LDLR (LDL receptor), ApoE (Apolipoprotein E), Apo B-100 (Apolipoprotein B-100), ApoA (Apolipoprotein(a)), ApoAl (Apolipoprotein A1), CBS (Cystathione B-synthase), Glycoprotein IIb/IIb, MTHRF (5,10-methylenetetrahydrofolate reductase (NADPH), and combinations thereof. In one iteration, the chromosomal sequences and proteins encoded by chromosomal sequences involved in cardiovascular disease may be chosen from CacnalC, Sod1, Pten, Ppar(alpha), Apo E, Leptin, and combinations thereof as target(s) for the CRISPR-Cas system.

Treating Diseases of the Liver and Kidney

The present invention also contemplates delivering the CRISPR-Cas system described herein, e.g. Cpf1 effector protein systems, to the liver and/or kidney. Delivery strategies to induce cellular uptake of the therapeutic nucleic acid include physical force or vector systems such as viral-, lipid- or complex-based delivery, or nanocarriers. From the initial applications with less possible clinical relevance, when nucleic acids were addressed to renal cells with hydrodynamic high pressure injection systemically, a wide range of gene therapeutic viral and non-viral carriers have been applied already to target posttranscriptional events in different animal kidney disease models in vivo (Csaba Revesz and Peter Hamar (2011). Delivery Methods to Target RNAs in the Kidney, Gene Therapy Applications, Prof. Chunsheng Kang (Ed.), ISBN: 978-953-307-541-9, InTech, Available from: www.intechopen.com/books/gene-therapy-applications/delivery-methods-to-target-rnas-inthe-kidney). Delivery methods to the kidney may include those in Yuan et al. (Am J Physiol Renal Physiol 295: F605-F617, 2008) investigated whether in vivo delivery of small interfering RNAs (siRNAs) targeting the 12/15-lipoxygenase (12/15-LO) pathway of arachidonate acid metabolism can ameliorate renal injury and diabetic nephropathy (DN) in a streptozotocininjected mouse model of type 1 diabetes. To achieve greater in vivo access and siRNA expression in the kidney, Yuan et al. used double-stranded 12/15-LO siRNA oligonucleotides conjugated with cholesterol. About 400 g of siRNA was injected subcutaneously into mice. The method of Yuang et al. may be applied to the CRISPR Cas system of the present invention contemplating a 1-2 g subcutaneous injection of CRISPR Cas conjugated with cholesterol to a human for delivery to the kidneys.

Molitoris et al. (J Am Soc Nephrol 20: 1754-1764, 2009) exploited proximal tubule cells (PTCs), as the site of oligonucleotide reabsorption within the kidney to test the efficacy of siRNA targeted to p53, a pivotal protein in the apoptotic pathway, to prevent kidney injury. Naked synthetic siRNA to p53 injected intravenously 4 h after ischemic injury maximally protected both PTCs and kidney function. Molitoris et al.'s data indicates that rapid delivery of siRNA to proximal tubule cells follows intravenous administration. For dose-response analysis, rats were injected with doses of siP53, 0.33; 1, 3, or 5 mg/kg, given at the same four time points, resulting in cumulative doses of 1.32; 4, 12, and 20 mg/kg, respectively. All siRNA doses tested produced a SCr reducing effect on day one with higher doses being effective over approximately five days compared with PBS-treated ischemic control rats. The 12 and 20 mg/kg cumulative doses provided the best protective effect. The method of Molitoris et al. may be applied to the nucleic acid-targeting system of the present invention contemplating 12 and 20 mg/kg cumulative doses to a human for delivery to the kidneys.

Thompson et al. (Nucleic Acid Therapeutics, Volume 22, Number 4, 2012) reports the toxicological and pharmacokinetic properties of the synthetic, small interfering RNA I5NP following intravenous administration in rodents and nonhuman primates. I5NP is designed to act via the RNA interference (RNAi) pathway to temporarily inhibit expression of the pro-apoptotic protein p53 and is being developed to protect cells from acute ischemia/reperfusion injuries such as acute kidney injury that can occur during major cardiac surgery and delayed graft function that can occur following renal transplantation. Doses of 800 mg/kg I5NP in rodents, and 1,000 mg/kg I5NP in nonhuman primates, were required to elicit adverse effects, which in the monkey were isolated to direct effects on the blood that included a sub-clinical activation of complement and slightly increased clotting times. In the rat, no additional adverse effects were observed with a rat analogue of I5NP, indicating that the effects likely represent class effects of synthetic RNA duplexes rather than toxicity related to the intended pharmacologic activity of I5NP. Taken together, these data support clinical testing of intravenous administration of I5NP for the preservation of renal function following acute ischemia/reperfusion injury. The no observed adverse effect level (NOAEL) in the monkey was 500 mg/kg. No effects on cardiovascular, respiratory, and neurologic parameters were observed in monkeys following i.v. administration at dose levels up to 25 mg/kg. Therefore, a similar dosage may be contemplated for intravenous administration of CRISPR Cas to the kidneys of a human.

Shimizu et al. (J Am Soc Nephrol 21: 622-633, 2010) developed a system to target delivery of siRNAs to glomeruli via poly(ethylene glycol)-poly(L-lysine)-based vehicles. The siRNA/nanocarrier complex was approximately 10 to 20 nm in diameter, a size that would allow it to move across the fenestrated endothelium to access to the mesangium. After intraperitoneal injection of fluorescence-labeled siRNA/nanocarrier complexes, Shimizu et al. detected siRNAs in the blood circulation for a prolonged time. Repeated intraperitoneal administration of a mitogen-activated protein kinase 1 (MAPK1) siRNA/nanocarrier complex suppressed glomerular MAPK1 mRNA and protein expression in a mouse model of glomerulonephritis. For the investigation of siRNA accumulation, Cy5-labeled siRNAs complexed with PIC nanocarriers (0.5 ml, 5 nmol of siRNA content), naked Cy5-labeled siRNAs (0.5 ml, 5 nmol), or Cy5-labeled siRNAs encapsulated in HVJ-E (0.5 ml, 5 nmol of siRNA content) were administrated to BALBc mice. The method of Shimizu et al. may be applied to the nucleic acid-targeting system of the present invention contemplating a dose of about of 10-20 tmol CRISPR Cas complexed with nanocarriers in about 1-2 μliters to a human for intraperitoneal administration and delivery to the kidneys.

Delivery Methods to the Kidney are Summarized as Follows:

TABLE 19

| Delivery method | Carrier | Target RNA | Disease | Model | Functional assays | Author |
|---|---|---|---|---|---|---|
| Hydrodynamic/ Lipid | TransIT In Vivo Gene Delivery System, DOTAP | p85α | Acute renal injury | Ischemia-reperfusion | Uptake, biodistribution | Larson et al., Surgery, (August 2007), Vol. 142, No. 2, pp. (262-269) |
| Hydrodynamic/ Lipid | Lipofectamine 2000 | Fas | Acute renal injury | Ischemia-reperfusion | Blood urea nitrogen, Fas Immunohisto chemistry, apoptosis, histological scoring | Hamar et al., Proc Natl Acad Sci, (October 2004), Vol. 101, No. 41, pp. (14883-14888) |
| Hydrodynamic | n.a. | Apoptosis cascade elements | Acute renal injury | Ischemia-reperfusion | n.a. | Zheng et al., Am J Pathol, (October 2008), Vol. 173, No. 4, pp. (973-980) |
| Hydrodynamic | n.a. | Nuclear factor kappa-b (NFkB) | Acute renal injury | Ischemia-reperfusion | n.a. | Feng et al., Transplantation, (May 2009), Vol. 87, No. 9, pp. (1283-1289) |

TABLE 19-continued

| Delivery method | Carrier | Target RNA | Disease | Model | Functional assays | Author |
|---|---|---|---|---|---|---|
| Hydrodynamic/ Viral | Lipofectamine 2000 | Apoptosis antagonizing transcription factor (AATF) | Acute renal injury | Ischemia-reperfusion | Apoptosis, oxidative stress, caspase activation, membrane lipid peroxidation | Xie & Guo, Am Soc Nephrol, (December 2006), Vol. 17, No. 12, pp. (3336-3346) |
| Hydrodynamic | pBAsi mU6 Neo/TransIT-EE Hydrodynamic Delivery System | Gremlin | Diabetic nephropathy | Streptozotozin-induced diabetes | Proteinuria, serum creatinine, glomerular and tubular diameter, collagen type IV/BMP7 expression | Q. Zhang et al., PloS ONE, (July 2010), Vol. 5, No. 7, e1 1709, pp. (1-13) |
| Viral/Lipid | pSUPER vector/ Lipofectamine | TGF-β type II receptor | Interstitial renal fibrosis | Unilateral urethral obstruction | α-SMA expression, collagen content, | Kushibikia et al., J Controlled Release, (July 2005), Vol. 105, No. 3, pp. (318-331) |
| Viral | Adeno-associated virus-2 | Mineral corticoid receptor | Hypertension caused renal damage | Cold-induced hypertension | blood pressure, serum albumin, serum urea nitrogen, serum creatinine, kidney weight, urinary sodium uptake | Wang et al., Gene Therapy, (July 2006), Vol. 13, No. 14, pp. (1097-1103) |
| Hydrodynamic/ Viral | pU6 vector | Luciferase | n.a. | n.a. | | Kobayashi et al., Journal of Pharmacology and Experimental Therapeutics, (February 2004), Vol. 308, No. 2, pp. (688-693) |
| Lipid | Lipoproteins, albumin | apoB1, apoM | n.a. | n.a. | Uptake, binding affinity to lipoproteins and albumin | Wolfrum et al., Nature Biotechnology, (September 2007), Vol. 25, No. 10, pp. (1149-1157) |
| Lipid | Lipofectamine 2000 | p53 | Acute renal injury | Ischemic and cisplatin-induced acute injury | Histological scoring, apoptosis | Molitoris et al., J Am Soc Nephrol, (August 2009), Vol. 20, No. 8, pp. (1754-1764) |
| Lipid | DOTAP/DOPE, DOTAP/DOPE/ DOPE-PEG2000 | COX-2 | Breast adeno-carcinoma | MDA-MB-231 breast cancer xenograft-bearing mouse | Cell viability, uptake | Mikhaylova et al., Cancer General Therapy, (March 2011), Vol. 16, No. 3, pp. (217-226) |
| Lipid | Cholesterol | 12/15-lipoxygenase | Diabetic nephropathy | Streptozotocin induced diabetes | Albuminuria, urinary creatinine, histology, type I and IV collagen, TGF-β, fibronectin, plasminogen activator inhibitor 1 | Yuan et al., Am J Physiol Renal Physiol, (June 2008), Vol. 295, pp. (F605-F617) |
| Lipid | Lipofectamine 2000 | Mitochondrial membrane | Diabetic nephro- | Streptozotocin-induced | Cell proliferation | Y. Zhang et al., J Am Soc |

TABLE 19-continued

| Delivery method | Carrier | Target RNA | Disease | Model | Functional assays | Author |
|---|---|---|---|---|---|---|
| | | 44 (TIM44) | pathy | diabetes | and apoptosis, histology, ROS, mitochondrial import of Mn-SOD and glutathione peroxidase, cellular membrane polarization | Nephrol, (April 2006), Vol. 17, No. 4, pp. (1090-1101) |
| Hydrodynamic/ Lipid | Proteoliposome | RLIP76 | Renal carcinoma | Caki-2 kidney cancer xenograft-bearing mouse | uptake | Singhal et al., Cancer Res, (May 2009), Vol. 69, No. 10, pp. (4244-4251) |
| Polymer | PEGylated PEI | Luciferase pGL3 | n.a. | n.a. | Uptake, biodistribution, erythrocyte aggregation | Malek et al., Toxicology and Applied Pharmacology, (April 2009), Vol. 236, No. 1, pp. (97-108) |
| Polymer | PEGylated poly-L-lysine | MAPK1 | Lupus glomerulo-nephritis | Glomerulo-nephritis | Proteinuria, glomeruloscle rosis, TGF-β, fibronectin, plasminogen activator inhibitor 1 | Shimizu et al., J Am Soc Nephrology, (April 2010), Vol. 21, No. 4, pp. (622-633) |
| Polymer/Nano particle | Hyaluronic acid/Quantum dot/PEI | VEGF | Kidney cancer/ melanoma | B16F1 melanoma tumor-bearing mouse | Biodistribution, citotoxicity, tumor volume, endocytosis | Jiang et al., Molecular Pharmaceutics, (May-June 2009), Vol. 6, No. 3, pp. (727-737) |
| Polymer/Nano particle | PEGylated polycapro-lactone nanofiber | GAPDH | n.a. | n.a. | cell viability, uptake | Cao et al, J Controlled Release, (June 2010), Vol. 144, No. 2, pp. (203-212) |
| Aptamer | Spiegelmer mNOX-E36 | CC chemokine ligand 2 | Glomerulo sclerosis | Uninephrecto-mized mouse | urinary albumin, urinary creatinine, histopathology, glomerular filtration rate, macrophage count, serum Ccl2, Mac-2+, Ki-67+ | Ninichuk et al., Am J Pathol, (March 2008), Vol. 172, No. 3, pp. (628-637) |
| Aptamer | Aptamer NOX-F37 | vasopressin (AVP) | Congestive heart failure | n.a. | Binding affinity to D-AVP, Inhibition of AVP Signaling, Urine osmolality and sodium concentration, | Purschke et al., Proc Natl Acad Sci, (March 2006), Vol. 103, No. 13, pp. (5173-5178) |

Targeting the Liver or Liver Cells

Targeting liver cells is provided. This may be in vitro or in vivo. Hepatocytes are preferred. Delivery of the CRISPR protein, such as Cpf1 herein may be via viral vectors, especially AAV (and in particular AAV2/6) vectors. These may be administered by intravenous injection.

A preferred target for liver, whether in vitro or in vivo, is the albumin gene. This is a so-called 'safe harbor" as albumin is expressed at very high levels and so some reduction in the production of albumin following successful gene editing is tolerated. It is also preferred as the high levels of expression seen from the albumin promoter/enhancer allows for useful levels of correct or transgene production (from the inserted donor template) to be achieved even if only a small fraction of hepatocytes are edited.

Intron 1 of albumin has been shown by Wechsler et al. (reported at the 57th Annual Meeting and Exposition of the American Society of Hematology—abstract available online at ash.confex.com/ash/2015/webprogram/Paper86495.html and presented on 6th December 2015) to be a suitable target site. Their work used Zn Fingers to cut the DNA at this target site, and suitable guide sequences can be generated to guide cleavage at the same site by a CRISPR protein.

The use of targets within highly-expressed genes (genes with highly active enhancers/promoters) such as albumin may also allow a promoterless donor template to be used, as reported by Wechsler et al. and this is also broadly applicable outside liver targeting. Other examples of highly-expressed genes are known.

Other Disease of the Liver

In particular embodiments, the CRISPR proteins of the present invention are used in the treatment of liver disorders such as transthyretin amyloidosis (ATTR), alpha-1 antitrypsin deficiency and other hepatic-based inborn errors of metabolism. FAP is caused by a mutation in the gene that encodes transthyretin (TTR). While it is an autosomal dominant disease, not all carriers develop the disease. There are over 100 mutations in the TTR gene known to be associated with the disease. Examples of common mutations include V30M. The principle of treatment of TTR based on gene silencing has been demonstrated by studies with iRNA (Ueda et al. 2014 Transl Neurogener. 3:19). Wilson's Disease (WD) is caused by mutations in the gene encoding ATP7B, which is found exclusively in the hepatocyte. There are over 500 mutations associated with WD, with increased prevalence in specific regions such as East Asia. Other examples are A1ATD (an autosomal recessive disease caused by mutations in the SERPINA1 gene) and PKU (an autosomal recessive disease caused by mutations in the phenylalanine hydroxylase (PAH) gene).

Liver—Associated Blood Disorders, Especially Hemophilia and in Particular Hemophilia B Successful gene editing of hepatocytes has been achieved in mice (both in vitro and in vivo) and in non-human primates (in vivo), showing that treatment of blood disorders through gene editing/genome engineering in hepatocytes is feasible. In particular, expression of the human F9 (hF9) gene in hepatocytes has been shown in non-human primates indicating a treatment for Hemophillia B in humans.

Wechsler et al. reported at the 57th Annual Meeting and Exposition of the American Society of Hematology (abstract presented 6th December 2015 and available online at ash.confex.com/ash/2015/webprogram/Paper86495.html) that they has successfully expressed human F9 (hF9) from hepatocytes in non-human primates through in vivo gene editing. This was achieved using 1) two zinc finger nucleases (ZFNs) targeting intron 1 of the albumin locus, and 2) a human F9 donor template construct. The ZFNs and donor template were encoded on separate hepatotropic adeno-associated virus serotype 2/6 (AAV2/6) vectors injected intravenously, resulting in targeted insertion of a corrected copy of the hF9 gene into the albumin locus in a proportion of liver hepatocytes.

The albumin locus was selected as a "safe harbor" as production of this most abundant plasma protein exceeds 10 g/day, and moderate reductions in those levels are well-tolerated. Genome edited hepatocytes produced normal hFIX (hF9) in therapeutic quantities, rather than albumin, driven by the highly active albumin enhancer/promoter. Targeted integration of the hF9 transgene at the albumin locus and splicing of this gene into the albumin transcript was shown.

Mice studies: $C_{57}BL/6$ mice were administered vehicle (n=20) or AAV2/6 vectors (n=25) encoding mouse surrogate reagents at 1.0 ×1013 vector genome (vg)/kg via tail vein injection. ELISA analysis of plasma hFIX in the treated mice showed peak levels of 50-1053 ng/mL that were sustained for the duration of the 6-month study. Analysis of FIX activity from mouse plasma confirmed bioactivity commensurate with expression levels.

Non-human primate (NHP) studies: a single intravenous co-infusion of AAV2/6 vectors encoding the NHP targeted albumin-specific ZFNs and a human F9 donor at 1.2×1013 vg/kg (n=5/group) resulted in >50 ng/mL (>1% of normal) in this large animal model. The use of higher AAV2/6 doses (up to 1.5×1014 vg/kg) yielded plasma hFIX levels up to 1000 ng/ml (or 20% of normal) in several animals and up to 2000 ng/ml (or 50% of normal) in a single animal, for the duration of the study (3 months).

The treatment was well tolerated in mice and NHPs, with no significant toxicological findings related to AAV2/6 ZFN+ donor treatment in either species at therapeutic doses. Sangamo (CA, USA) has since applied to the FDA, and been granted, permission to conduct the world's first human clinical trial for an in vivo genome editing application. This follows on the back of the EMEA's approval of the Glybera gene therapy treatment of lipoprotein lipase deficiency.

Accordingly, it is preferred, in some embodiments, that any or all of the following are used: AAV (especially AAV2/6) vectors, preferably administered by intravenous injection; Albumin as target for gene editing/insertion of transgene/template-especially at intron 1 of albumin; human F9 donor template; and/or a promoterless donor template.

Hemophilia B

Accordingly, in some embodiments, it is preferred that the present invention is used to treat Hemophilia B. As such it is preferred that F9 (Factor IX) is targeted through provision of a suitable guide RNA. The enzyme and the guide may ideally be targeted to the liver where F9 is produced, although they can be delivered together or separately. A template is provided, in some embodiments, and that this is the human F9 gene. It will be appreciated that the hF9 template comprises the wt or 'correct' version of hF9 so that the treatment is effective. In some embodiments, a two-vector system may be used-one vector for the Cas and one vector for the repair template(s). The repair template may include two or more repair templates, for example, two F9 sequences from different mammalian species. In some embodiments, both a mouse and human F9 sequence are provided. This may be delivered to mice. Yang Yang, John White, McMenamin Deirdre, and Peter Bell, PhD, presenting at 58th Annual American Society of Hematology Meeting (November 2016), report that this increases potency and accuracy. The second vector inserted the human sequence of factor IX into the mouse genome. In some embodiments, the targeted insertion leads to the expression of a chimeric hyperactive factor IX protein. In some embodiments, this is under the control of the native mouse factor IX promoter. Injecting this two-component system (vector 1 and vector 2) into newborn and adult "knock-out" mice at increasing doses led to expression and activity of stable factor IX activity at normal (or even higher) levels for over four months. In the case of treating humans, a native human F9 promoter may be used instead. In some embodiments, the wt phenotype is restored.

In an alternative embodiment, the hemophilia B version of F9 may be delivered so as to create a model organism, cell or cell line (for example a murine or non-human primate model organism, cell or cell line), the model organism, cell or cell line having or carrying the Hemophilia B phenotype, i.e. an inability to produce wt F9.

Hemophilia A

In some embodiments, the F9 (factor IX) gene may be replaced by the F8 (factor VIII) gene described above, leading to treatment of Hemophilia A (through provision of a correct F8 gene) and/or creation of a Hemophilia A model organism, cell or cell line (through provision of an incorrect, Hemophilia A version of the F8 gene).

Hemophilia C

In some embodiments, the F9 (factor IX) gene may be replaced by the F11 (factor XI) gene described above, leading to treatment of Hemophilia C (through provision of a correct F11 gene) and/or creation of a Hemophilia C model organism, cell or cell line (through provision of an incorrect, Hemophilia C version of the F 11 gene).

Transthyretin Amyloidosis

Transthyretin is a protein, mainly produced in the liver, present in the serum and CSF which carries thyroxin hormone and retinol binding protein bound to retinol (Vitamin A). Over 120 different mutations can cause Transthyretin amyloidosis (ATTR), a heritable genetic disorder wherein mutant forms of the protein aggregate in tissues, particularly the peripheral nervous system, causing polyneuropathy. Familial amyloid polyneuropathy (FAP) is the most common TTR disorder and, in 2014, was thought to affect 47 per 100,000 people in Europe. A mutation in the TTR gene of Val30Met is thought be the most common mutation, causing an estimated 50% of FAP cases. In the absence of a liver transplant, the only known cure to date, the disease is usually fatal within a decade of diagnosis. The majority of cases are monogenic.

In mouse models of ATTR, the TTR gene may be edited in a dose dependent manner by the delivery of CRISPR/Cas9. In some embodiments, the Cas is provided as mRNA. In some embodiments, Cas mRNA and guide RNA are packaged in LNPs. A system comprising Cas mRNA and guide RNA packaged in LNPs achieved up to 60% editing efficiency in the liver, with serum TTR levels being reduced by up to 80%. In some embodiments, therefore, Transthyretin is targeted, in particular correcting for the Val30Met mutation. In some embodiments, therefore, ATTR is treated.

Alpha-1 Antitrypsin Deficiency

Alpha-1 Antitrypsin (A1AT) is a protein produced in the liver which primarily functions to decrease the activity of neutrophil elastase, an enzyme which degrades connective tissue, in the lungs. Alpha-1 Antitrypsin Deficiency (ATTD) is a disease caused by mutation of the SERPINA1 gene, which encodes A1AT. Impaired production of AAT leads to a gradual degradation of the connective tissue of the lung resulting in emphysema like symptoms.

Several mutations can cause ATTD, though the most common mutations are Glu342Lys (referred to as Z allele, wild-type is referred to as M) or Glu264Val (referred to as the S allele), and each allele contributes equally to the disease state, with two affected alleles resulting in more pronounced pathophysiology. These results not only resulted in degradation of the connective tissue of sensitive organs, such as the lung, but accumulation of the mutants in the liver can result in proteotoxicity. Current treatments focus on the replacement of A1AT by injection of protein retrieved from donated human plasma. In severe cases a lung and/or liver transplant may be considered.

The common variants of the disease are again monogenic. In some embodiments, the SERPINA1 gene is targeted. In some embodiments, the Glu342Lys mutation (referred to as Z allele, wild-type is referred to as M) or the Glu264Val mutation (referred to as the S allele) are corrected for. In some embodiments, therefore, the faulty gene would require replacement by the wild-type functioning gene. In some embodiments, a knockout and repair approach is required, so a repair template is provided. In the case of bi-allelic mutations, in some embodiments only one guide RNA would be required for homozygous mutations, but in the case of heterozygous mutations two guide RNAs may be required. Delivery is, in some embodiments, to the lung or liver.

Inborn Errors of Metabolism

Inborn errors of metabolism (IEMs) are an umbrella group of diseases which affect metabolic processes. In some embodiments, an IEM is to be treated. The majority of these diseases are monogenic in nature (e.g. phenylketonuria) and the pathophysiology results from either the abnormal accumulation of substances which are inherently toxic, or mutations which result in an inability to synthesize essential substances. Depending on the nature of the IEM, CRISPR/Cas may be used to facilitate a knock-out alone, or in combination with replacement of a faulty gene via a repair template. Exemplary diseases that may benefit from CRISPR/Cas technology are, in some embodiments: primary hyperoxaluria type 1 (PHi), argininosuccinic lyase deficiency, ornithine transcarbamylase deficiency, phenylketonuria, or PKU, and maple syrup urine disease.

Treating Epithelial and Lung Diseases

The present invention also contemplates delivering the CRISPR-Cas system described herein, e.g. Cpf1 effector protein systems, to one or both lungs.

Although AAV-2-based vectors were originally proposed for CFTR delivery to CF airways, other serotypes such as AAV-1, AAV-5, AAV-6, and AAV-9 exhibit improved gene transfer efficiency in a variety of models of the lung epithelium (see, e.g., Li et al., Molecular Therapy, vol. 17 no. 12, 2067-277 December 2009). AAV-1 was demonstrated to be ~100-fold more efficient than AAV-2 and AAV-5 at transducing human airway epithelial cells in vitro,5 although AAV-1 transduced murine tracheal airway epithelia in vivo with an efficiency equal to that of AAV-5. Other studies have shown that AAV-5 is 50-fold more efficient than AAV-2 at gene delivery to human airway epithelium (HAE) in vitro and significantly more efficient in the mouse lung airway epithelium in vivo. AAV-6 has also been shown to be more efficient than AAV-2 in human airway epithelial cells in vitro and murine airways in vivo.8 The more recent isolate, AAV-9, was shown to display greater gene transfer efficiency than AAV-5 in murine nasal and alveolar epithelia in vivo with gene expression detected for over 9 months suggesting AAV may enable long-term gene expression in vivo, a desirable property for a CFTR gene delivery vector.

Furthermore, it was demonstrated that AAV-9 could be readministered to the murine lung with no loss of CFTR expression and minimal immune consequences. CF and non-CF HAE cultures may be inoculated on the apical surface with 100 µl of AAV vectors for hours (see, e.g., Li et al., Molecular Therapy, vol. 17 no. 12, 2067-277 December 2009). The MOI may vary from $1\times10^3$ to $4\times10^5$ vector genomes/cell, depending on virus concentration and purposes of the experiments. The above cited vectors are contemplated for the delivery and/or administration of the invention.

Zamora et al. (Am J Respir Crit Care Med Vol 183. pp 531-538, 2011) reported an example of the application of an RNA interference therapeutic to the treatment of human infectious disease and also a randomized trial of an antiviral drug in respiratory syncytial virus (RSV)-infected lung transplant recipients. Zamora et al. performed a randomized, double-blind, placebo controlled trial in LTX recipients with RSV respiratory tract infection. Patients were permitted to receive standard of care for RSV. Aerosolized ALN-RSV01 (0.6 mg/kg) or placebo was administered daily for 3 days. This study demonstrates that an RNAi therapeutic targeting RSV can be safely administered to LTX recipients with RSV infection. Three daily doses of ALN-RSV01 did not result in any exacerbation of respiratory tract symptoms or impairment of lung function and did not exhibit any systemic proinflammatory effects, such as induction of cytokines or CRP. Pharmacokinetics showed only low, transient systemic exposure after inhalation, consistent with preclinical animal data showing that ALN-RSV01, administered intravenously or by inhalation, is rapidly cleared from the circulation through exonucleasemediated digestion and renal excretion. The method of Zamora et al. may be applied to the nucleic acid-targeting system of the present invention and an aerosolized CRISPR Cas, for example with a dosage of 0.6 mg/kg, may be contemplated for the present invention.

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector. In this instance, the following constructs are provided as examples: Cbh or EFla promoter for Cas, U6 or H1 promoter for guide RNA),: A preferred arrangement is to use a CFTRdelta508 targeting guide, a repair template for deltaF508 mutation and a codon optimized Casenzyme, with optionally one or more nuclear localization signal or sequence(s) (NLS(s)), e.g., two (2) NLSs. Constructs without NLS are also envisaged.

Treating Diseases of the Muscular System

The present invention also contemplates delivering the CRISPR-Cas system described herein, e.g. Caseffector protein systems, to muscle(s).

Bortolanza et al. (Molecular Therapy vol. 19 no. 11, 2055-264 November 2011) shows that systemic delivery of RNA interference expression cassettes in the FRG1 mouse, after the onset of facioscapulohumeral muscular dystrophy (FSHD), led to a dose-dependent long-term FRG1 knockdown without signs of toxicity. Bortolanza et al. found that a single intravenous injection of $5\times10^{12}$ vg of rAAV6-sh1FRG1 rescues muscle histopathology and muscle function of FRG1 mice. In detail, 200 l containing $2\times10^{12}$ or $5\times10^{12}$ vg of vector in physiological solution were injected into the tail vein using a 25-gauge Terumo syringe. The method of Bortolanza et al. may be applied to an AAV expressing CRISPR Cas and injected into humans at a dosage of about $2\times10^{15}$ or $2\times10^{16}$ vg of vector.

Dumonceaux et al. (Molecular Therapy vol. 18 no. 5, 881-887 May 2010) inhibit the myostatin pathway using the technique of RNA interference directed against the myostatin receptor AcvRIIb mRNA (sh-AcvRIIb). The restoration of a quasi-dystrophin was mediated by the vectorized U7 exon-skipping technique (U7-DYS). Adeno-associated vectors carrying either the sh-AcvrIIb construct alone, the U7-DYS construct alone, or a combination of both constructs were injected in the tibialis anterior (TA) muscle of dystrophic mdx mice. The injections were performed with $10^{11}$ AAV viral genomes. The method of Dumonceaux et al. may be applied to an AAV expressing CRISPR Cas and injected into humans, for example, at a dosage of about $10^{14}$ to about $10^{15}$ vg of vector.

Kinouchi et al. (Gene Therapy (2008) 15, 1126-1130) report the effectiveness of in vivo siRNA delivery into skeletal muscles of normal or diseased mice through nanoparticle formation of chemically unmodified siRNAs with atelocollagen (ATCOL). ATCOL-mediated local application of siRNA targeting myostatin, a negative regulator of skeletal muscle growth, in mouse skeletal muscles or intravenously, caused a marked increase in the muscle mass within a few weeks after application. These results imply that ATCOL-mediated application of siRNAs is a powerful tool for future therapeutic use for diseases including muscular atrophy. MstsiRNAs (final concentration, 10 mM) were mixed with ATCOL (final concentration for local administration, 0.5%) (AteloGene, Kohken, Tokyo, Japan) according to the manufacturer's instructions. After anesthesia of mice (20-week-old male C57BL/6) by Nembutal (25 mg/kg, i.p.), the Mst-siRNA/ATCOL complex was injected into the masseter and biceps femoris muscles. The method of Kinouchi et al. may be applied to CRISPR Cas and injected into a human, for example, at a dosage of about 500 to 1000 ml of a 40 M solution into the muscle. Hagstrom et al. (Molecular Therapy Vol. 10, No. 2, August 2004) describe an intravascular, nonviral methodology that enables efficient and repeatable delivery of nucleic acids to muscle cells (myofibers) throughout the limb muscles of mammals. The procedure involves the injection of naked plasmid DNA or siRNA into a distal vein of a limb that is transiently isolated by a tourniquet or blood pressure cuff. Nucleic acid delivery to myofibers is facilitated by its rapid injection in sufficient volume to enable extravasation of the nucleic acid solution into muscle tissue. High levels of transgene expression in skeletal muscle were achieved in both small and large animals with minimal toxicity. Evidence of siRNA delivery to limb muscle was also obtained. For plasmid DNA intravenous injection into a rhesus monkey, a threeway stopcock was connected to two syringe pumps (Model PHD 2000; Harvard Instruments), each loaded with a single syringe. Five minutes after a papaverine injection, pDNA (15.5 to 25.7 mg in 40 –100 ml saline) was injected at a rate of 1.7 or 2.0 ml/s. This could be scaled up for plasmid DNA expressing CRISPR Cas of the present invention with an injection of about 300 to 500 mg in 800 to 2000 ml saline for a human. For adenoviral vector injections into a rat, $2\times10'$ infectious particles were injected in 3 ml of normal saline solution (NSS). This could be scaled up for an adenoviral vector expressing CRISPR Cas of the present invention with an injection of about $1\times10^{13}$ infectious particles were injected in 10 liters of NSS for a human. For siRNA, a rat was injected into the great saphenous vein with 12.5 g of a siRNA and a primate was injected into the great saphenous vein with 750 g of a siRNA. This could be scaled up for a CRISPR Cas of the present invention, for example, with an injection of about 15 to about 50 mg into the great saphenous vein of a human.

See also, for example, WO2013163628 A2, Genetic Correction of Mutated Genes, published application of Duke University describes efforts to correct, for example, a frameshift mutation which causes a premature stop codon and a truncated gene product that can be corrected via nuclease mediated non-homologous end joining such as those responsible for Duchenne Muscular Dystrophy, ("DMD") a recessive, fatal, X-linked disorder that results in muscle degeneration due to mutations in the dystrophin gene. The majority of dystrophin mutations that cause DMD are deletions of exons that disrupt the reading frame and cause premature translation termination in the dystrophin gene. Dystrophin is a cytoplasmic protein that provides structural stability to the dystroglycan complex of the cell membrane that is responsible for regulating muscle cell integrity and function. The dystrophin gene or "DMD gene" as used interchangeably herein is 2.2 megabases at locus Xp21. The primary transcription measures about 2,400 kb with the mature mRNA being about 14 kb. 79 exons code for the protein which is over 3500 amino acids. Exon 51 is frequently adjacent to frame-disrupting deletions in DMD patients and has been targeted in clinical trials for oligonucleotide-based exon skipping. A clinical trial for the exon 51 skipping compound eteplirsen recently reported a significant functional benefit across 48 weeks, with an average of 47% dystrophin positive fibers compared to baseline. Mutations in exon 51 are ideally suited for permanent correction by NHEJ-based genome editing.

The methods of US Patent Publication No. 20130145487 assigned to Cellectis, which relates to meganuclease variants to cleave a target sequence from the human dystrophin gene (DMD), may also be modified to for the nucleic acid-targeting system of the present invention.

Treating Diseases of the Skin

The present invention also contemplates delivering the CRISPR-Cas system described herein to the skin.

Hickerson et al. (Molecular Therapy-Nucleic Acids (2013) 2, e129) relates to a motorized microneedle array skin delivery device for delivering self-delivery (sd)-siRNA to human and murine skin. The primary challenge to translating siRNA-based skin therapeutics to the clinic is the development of effective delivery systems. Substantial effort has been invested in a variety of skin delivery technologies with limited success. In a clinical study in which skin was treated with siRNA, the exquisite pain associated with the hypodermic needle injection precluded enrollment of additional patients in the trial, highlighting the need for improved, more "patient-friendly" (i.e., little or no pain) delivery approaches. Microneedles represent an efficient way to deliver large charged cargos including siRNAs across the primary barrier, the stratum corneum, and are generally regarded as less painful than conventional hypodermic needles. Motorized "stamp type" microneedle devices, including the motorized microneedle array (MMNA) device used by Hickerson et al., have been shown to be safe in hairless mice studies and cause little or no pain as evidenced by (i) widespread use in the cosmetic industry and (ii) limited testing in which nearly all volunteers found use of the device to be much less painful than a flushot, suggesting siRNA delivery using this device will result in much less pain than was experienced in the previous clinical trial using hypodermic needle injections. The MMNA device (marketed as Triple-M or Tri-M by Bomtech Electronic Co, Seoul, South Korea) was adapted for delivery of siRNA to mouse and human skin. sd-siRNA solution (up to 300 μl of 0.1 mg/ml RNA) was introduced into the chamber of the disposable Tri-M needle cartridge (Bomtech), which was set to a depth of 0.1 mm. For treating human skin, deidentified skin (obtained immediately following surgical procedures) was manually stretched and pinned to a cork platform before treatment. All intradermal injections were performed using an insulin syringe with a 28-gauge 0.5-inch needle. The MMNA device and method of Hickerson et al. could be used and/or adapted to deliver the CRISPR Cas of the present invention, for example, at a dosage of up to 300 l of 0.1 mg/ml CRISPR Cas to the skin.

Leachman et al. (Molecular Therapy, vol. 18 no. 2, 442-446 February 2010) relates to a phase Ib clinical trial for treatment of a rare skin disorder pachyonychia congenita (PC), an autosomal dominant syndrome that includes a disabling plantar keratoderma, utilizing the first short-interfering RNA (siRNA)-based therapeutic for skin. This siRNA, called TD101, specifically and potently targets the keratin 6a (K6a) N171K mutant mRNA without affecting wild-type K6a mRNA.

Zheng et al. (PNAS, Jul. 24, 2012, vol. 109, no. 30, 11975-11980) show that spherical nucleic acid nanoparticle conjugates (SNA-NCs), gold cores surrounded by a dense shell of highly oriented, covalently immobilized siRNA, freely penetrate almost 100% of keratinocytes in vitro, mouse skin, and human epidermis within hours after application. Zheng et al. demonstrated that a single application of 25 nM epidermal growth factor receptor (EGFR) SNA-NCs for 60 h demonstrate effective gene knockdown in human skin. A similar dosage may be contemplated for CRISPR Cas immobilized in SNA-NCs for administration to the skin.

Cancer

In some embodiments, the treatment, prophylaxis or diagnosis of cancer is provided. The target is preferably one or more of the FAS, BID, CTLA4, PDCD1, CBLB, PTPN6, TRAC or TRBC genes. The cancer may be one or more of lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DLCL), multiple myeloma, renal cell carcinoma (RCC), neuroblastoma, colorectal cancer, breast cancer, ovarian cancer, melanoma, sarcoma, prostate cancer, lung cancer, esophageal cancer, hepatocellular carcinoma, pancreatic cancer, astrocytoma, mesothelioma, head and neck cancer, and medulloblastoma. This may be implemented with engineered chimeric antigen receptor (CAR) T cell. This is described in WO2015161276, the disclosure of which is hereby incorporated by reference and described herein below.

Target genes suitable for the treatment or prophylaxis of cancer may include, in some embodiments, those described in WO2015048577 the disclosure of which is hereby incorporated by reference.

Usher Syndrome or Retinitis Pigmentosa-39

In some embodiments, the treatment, prophylaxis or diagnosis of Usher Syndrome or retinitis pigmentosa-39 is provided. The target is preferably the USH2A gene. In some embodiments, correction of a G deletion at position 2299 (2299delG) is provided. This is described in WO2015134812A1, the disclosure of which is hereby incorporated by reference.

Autoimmune and Inflammatory Disorders

In some embodiments, autoimmune and inflammatory disorders are treated. These include Multiple Sclerosis (MS) or Rheumatoid Arthritis (RA), for example.

Cystic Fibrosis (CF)

In some embodiments, the treatment, prophylaxis or diagnosis of cystic fibrosis is provided. The target is preferably the SCNN1A or the CFTR gene. This is described in WO2015157070, the disclosure of which is hereby incorporated by reference.

Schwank et al. (Cell Stem Cell, 13:653-58, 2013) used CRISPR-Cas9 to correct a defect associated with cystic fibrosis in human stem cells. The team's target was the gene for an ion channel, cystic fibrosis transmembrane conductor receptor (CFTR). A deletion in CFTR causes the protein to misfold in cystic fibrosis patients. Using cultured intestinal stem cells developed from cell samples from two children with cystic fibrosis, Schwank et al. were able to correct the defect using CRISPR along with a donor plasmid containing the reparative sequence to be inserted. The researchers then grew the cells into intestinal "organoids," or miniature guts, and showed that they functioned normally. In this case, about half of clonal organoids underwent the proper genetic correction.

In some embodiments, Cystic fibrosis is treated, for example. Delivery to the lungs is therefore preferred. The F508 mutation (delta-F508, full name CFTRAF508 or F508del-CFTR) is preferably corrected. In some embodiments, the targets may be ABCC7, CF or MRP7.

Duchenne's Muscular Dystrophy

Duchenne's muscular dystrophy (DMD) is a recessive, sex-linked muscle wasting disease that affects approximately 1 in 5000 males at birth. Mutations of the dystrophin gene result in an absence of dystrophin in skeletal muscle, where it normally functions to connect the cytoskeleton of the muscle fiber to the basal lamina. The absence of dystrophin caused be these mutations results in excessive calcium entry into the soma which causes the mitochondria to rupture, destroying the cell. Current treatments are focused on easing the symptoms of DMD, and the average life expectancy is approximately 26 years.

CRISPR/Cas9 efficacy as a treatment for certain types of DMD has been demonstrated in mouse models. In one such study, the muscular dystrophy phenotype was partially corrected in the mouse by knocking-out a mutant exon resulting in a functional protein (see Nelson et al. (2016) Science, Long et al. (2016) Science, and Tabebordbar et al. (2016) Science).

In some embodiments, DMD is treated. In some embodiments, delivery is to the muscle by injection.

Glycogen Storage Diseases, Including 1a

Glycogen Storage Disease 1a is a genetic disease resulting from deficiency of the enzyme glucose-6-phosphatase. The deficiency impairs the ability of the liver to produce free glucose from glycogen and from gluconeogenesis. In some embodiments, the gene encoding the glucose-6-phosphatase enzyme is targeted. In some embodiments, Glycogen Storage Disease 1a is treated. In some embodiments, delivery is to the liver by encapsulation of the Cas (in protein or mRNA form) in a lipid particle, such as an LNP.

In some embodiments, Glycogen Storage Diseases, including 1a, are targeted and preferably treated, for example by targeting polynucleotides associated with the condition/disease/infection. The associated polynucleotides include DNA, which may include genes (where genes include any coding sequence and regulatory elements such as enhancers or promoters). In some embodiments, the associated polynucleotides may include the SLC2A2, GLUT2, G6PC, G6PT, G6PT1, GAA, LAMP2, LAMPB, AGL, GDE, GBE1, GYS2, PYGL, or PFKM genes.

Hurler Syndrome

Hurler syndrome, also known as mucopolysaccharidosis type I (MPS I), Hurler's disease, is a genetic disorder that results in the buildup of glycosaminoglycans (formerly known as mucopolysaccharides) due to a deficiency of alpha-L iduronidase, an enzyme responsible for the degradation of mucopolysaccharides in lysosomes. Hurler syndrome is often classified as a lysosomal storage disease, and is clinically related to Hunter Syndrome. Hunter syndrome is X-linked while Hurler syndrome is autosomal recessive. MPS I is divided into three subtypes based on severity of symptoms. All three types result from an absence of, or insufficient levels of, the enzyme α-L-iduronidase. MPS I H or Hurler syndrome is the most severe of the MPS I subtypes. The other two types are MPS I S or Scheie syndrome and MPS I H-S or Hurler-Scheie syndrome. Children born to an MPS I parent carry a defective IDUA gene, which has been mapped to the 4p16.3 site on chromosome 4. The gene is named IDUA because of its iduronidase enzyme protein product. As of 2001, 52 different mutations in the IDUA gene have been shown to cause Hurler syndrome. Successful treatment of the mouse, dog, and cat models of MPS I by delivery of the iduronidase gene through retroviral, lentiviral, AAV, and even nonviral vectors.

In some embodiments, the α-L-iduronidase gene is targeted and a repair template preferably provided.

HIV and AIDS

In some embodiments, the treatment, prophylaxis or diagnosis of HIV and AIDS is provided. The target is preferably the CCR5 gene in HIV. This is described in WO2015148670A1, the disclosure of which is hereby incorporated by reference.

Beta Thalassaemia

In some embodiments, the treatment, prophylaxis or diagnosis of Beta Thalassaemia is provided. The target is preferably the BCL11A gene. This is described in WO2015148860, the disclosure of which is hereby incorporated by reference.

Sickle Cell Disease (SCD)

In some embodiments, the treatment, prophylaxis or diagnosis of Sickle Cell Disease (SCD) is provided. The target is preferably the HBB or BCL11A gene. This is described in WO2015148863, the disclosure of which is hereby incorporated by reference.

Herpes Simplex Virus 1 and 2

Herpesviridae are a family of viruses composed of linear double-stranded DNA genomes with 75-200 genes. For the purposes of gene editing, the most commonly studied family member is Herpes Simplex Virus—1 (HSV-1), a virus which has a distinct number of advantages over other viral vectors (reviewed in Vannuci et al. (2003)). Thus, in some embodiments, the viral vector is an HSV viral vector. In some embodiments, the HSV viral vector is HSV-1.

HSV-1 has a large genome of approximately 152 kb of double stranded DNA. This genome comprises of more than 80 genes, many of which can be replaced or removed, allowing a gene insert of between 30-150 kb. The viral vectors derived from HSV-1 are generally separated into 3 groups: replication-competant attenuated vectors, replication-incompetent recombinant vectors, and defective helper-dependent vectors known as amplicons. Gene transfer using HSV-1 as a vector has been demonstrated previously, for instance for the treatment of neuropathic pain (see, e.g., Wolfe et al. (2009) Gene Ther) and rheumatoid arthritis (see e.g., Burton et al. (2001) Stem Cells).

Thus, in some embodiments, the viral vector is an HSV viral vector. In some embodiments, the HSV viral vector is HSV-1. In some embodiments, the vector is used for delivery of one or more CRISPR components. It may be particularly useful for delvery of the Cas and one or more guide RNAs, for example 2 or more, 3 or more, or 4 or more guide RNAs. In some embodiments, the vector is threreorfore useful in a multiplex system. In some embodiments, this delivery is for the treatment of treatment of neuropathic pain or rheumatoid arthritis.

In some embodiments, the treatment, prophylaxis or diagnosis of HSV-1 (Herpes Simplex Virus 1) is provided. The target is preferably the UL19, UL30, UL48 or UL50 gene in HSV-1. This is described in WO2015153789, the disclosure of which is hereby incorporated by reference.

In other embodiments, the treatment, prophylaxis or diagnosis of HSV-2 (Herpes Simplex Virus 2) is provided. The target is preferably the UL19, UL30, UL48 or UL50 gene in HSV-2. This is described in WO2015153791, the disclosure of which is hereby incorporated by reference.

In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference.

Adoptive Cell Therapies

The present invention also contemplates use of the CRISPR-Cas system described herein, e.g. Cas effector protein systems, to modify cells for adoptive therapies. Aspects of the invention accordingly involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; and, Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with chimeric antigen receptor-modified T cells. Immunol Rev. 257(1): 127-144). Various strategies may for example be employed to genetically modify T cells by altering the specificity of the T cell receptor (TCR) for example by introducing new TCR a and β chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8a hinge domain and a CD8a transmembrane domain, to the transmembrane and intracellular signaling domains of either CD3(or FcRy (scFv-CD3(or scFv-FcRy; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3(; see U.S. Pat. Nos. 8,911,993; 8,916,381; 8,975,071; 9,101,584; 9,102,760; 9,102,761). Third-generation CARs include a combination of costimulatory endodomains, such a CD3(-chain, CD97, GDI 1a-CD18, CD2, ICOS, CD27, CD154, CDS, OX40, 4-1BB, or CD28 signaling domains (for example scFv-CD28-4-1BB-CD3(or scFv-CD28-OX40-CD3(; see U.S. Pat. Nos. 8,906,682; 8,399,645; 5,686,281; PCT Publication No. WO2014134165; PCT Publication No. WO2012079000). Alternatively, costimulation may be orchestrated by expressing CARs in antigen-specific T cells, chosen so as to be activated and expanded following engagement of their native aPTCR, for example by antigen on professional antigen-presenting cells, with attendant costimulation. In addition, additional engineered receptors may be provided on the immunoresponsive cells, for example to improve targeting of a T-cell attack and/or minimize side effects.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3(and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with 7-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to threat tumor xenografts.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoreponsive cell, thereby treating or preventing the disease (such as a neoplasia, a pathogen infection, an autoimmune disorder, or an allogeneic transplant reaction). Dosing in CAR T cell therapies may for example involve administration of from 106 to 109 cells/kg, with or without a course of lymphodepletion, for example with cyclophosphamide.

In one embodiment, the treatment can be administrated into patients undergoing an immunosuppressive treatment. The cells or population of cells, may be made resistant to at least one immunosuppressive agent due to the inactivation of a gene encoding a receptor for such immunosuppressive agent. Not being bound by a theory, the immunosuppressive treatment should help the selection and expansion of the immunoresponsive or T cells according to the invention within the patient.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of 104-109 cells per kg body weight, preferably 105 to 106 cells/kg body weight including all integer values of cell numbers within those ranges. Dosing in CAR T cell therapies may for example involve administration of from 106 to 109 cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6: 95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6):1107-15 (2010)).

In a further refinement of adoptive therapies, genome editing with a CRISPR-Cas system as described herein may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853). For example, immunoresponsive cells may be edited to delete expression of some or all of the class of HLA type II and/or type I molecules, or to knockout selected genes that may inhibit the desired immune response, such as the PD1 gene.

Cells may be edited using any CRISPR system and method of use thereof as described herein. CRISPR systems may be delivered to an immune cell by any method described herein. In preferred embodiments, cells are edited ex vivo and transferred to a subject in need thereof. Immunoresponsive cells, CAR T cells or any cells used for adoptive cell transfer may be edited. Editing may be performed to eliminate potential alloreactive T-cell receptors (TCR), disrupt the target of a chemotherapeutic agent, block an immune checkpoint, activate a T cell, and/or increase the differentiation and/or proliferation of functionally exhausted or dysfunctional CD8+ T-cells (see PCT Patent Publications: WO2013176915, WO2014059173, WO2014172606, WO2014184744, and WO2014191128). Editing may result in inactivation of a gene.

By inactivating a gene it is intended that the gene of interest is not expressed in a functional protein form. In a particular embodiment, the CRISPR system specifically catalyzes cleavage in one targeted gene thereby inactivating said targeted gene. The nucleic acid strand breaks caused are commonly repaired through the distinct mechanisms of homologous recombination or non-homologous end joining (NHEJ). However, NHEJ is an imperfect repair process that often results in changes to the DNA sequence at the site of the cleavage. Repair via non-homologous end joining (NHEJ) often results in small insertions or deletions (Indel) and can be used for the creation of specific gene knockouts. Cells in which a cleavage induced mutagenesis event has occurred can be identified and/or selected by well-known methods in the art.

T cell receptors (TCR) are cell surface receptors that participate in the activation of T cells in response to the presentation of antigen. The TCR is generally made from two chains, α and β, which assemble to form a heterodimer and associates with the CD3-transducing subunits to form the T cell receptor complex present on the cell surface. Each α and β chain of the TCR consists of an immunoglobulin-like N-terminal variable (V) and constant (C) region, a hydrophobic transmembrane domain, and a short cytoplasmic region. As for immunoglobulin molecules, the variable region of the α and β chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCRα or TCRβ can result in the elimination of the TCR from the surface of T cells preventing recognition of alloantigen and thus GVHD.

However, TCR disruption generally results in the elimination of the CD3 signaling component and alters the means of further T cell expansion.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1;112(12):4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson HA, et al., SHP-1: the next checkpoint target for cancer immunotherapy?Biochem Soc Trans. 2016 Apr. 15; 44(2):356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

WO2014172606 relates to the use of MT1 and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1 or TIM-3. In preferred embodiments, the gene locus involved in the expression of PD-1 or CTLA-4 genes is targeted. In other preferred embodiments, combinations of genes are targeted, such as but not limited to PD-1 and TIGIT.

In other embodiments, at least two genes are edited. Pairs of genes may include, but are not limited to PD1 and TCRa, PD1 and TCRβ, CTLA-4 and TCRa, CTLA-4 and TCRβ, LAG3 and TCRa, LAG3 and TCRβ, Tim3 and TCRa, Tim3 and TCRβ, BTLA and TCRa, BTLA and TCRβ, BY55 and TCRa, BY55 and TCRβ, TIGIT and TCRa, TIGIT and TCRβ, B7H5 and TCRa, B7H5 and TCRβ, LAIR1 and TCRa, LAIR1 and TCRβ, SIGLEC10 and TCRa, SIGLEC10 and TCRβ, 2B4 and TCRa, 2B4 and TCRβ.

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

The practice of the present invention employs, unless otherwise indicated, conventional techniques of immunology, biochemistry, chemistry, molecular biology, microbiology, cell biology, genomics and recombinant DNA, which are within the skill of the art. See MOLECULAR CLONING: A LABORATORY MANUAL, 2nd edition (1989) (Sambrook, Fritsch and Maniatis); MOLECULAR CLONING: A LABORATORY MANUAL, 4th edition (2012) (Green and Sambrook); CURRENT PROTOCOLS IN MOLECULAR BIOLOGY (1987) (F. M. Ausubel, et al. eds.); the series METHODS IN ENZYMOLOGY (Academic Press, Inc.); PCR 2: A PRACTICAL APPROACH (1995) (M. J. MacPherson, B. D. Hames and G. R. Taylor eds.); ANTIBODIES, A LABORATORY MANUAL (1988) (Harlow and Lane, eds.); ANTIBODIES A LABORATORY MANUAL, 2nd edition (2013) (E. A. Greenfield ed.); and ANIMAL CELL CULTURE (1987) (R. I. Freshney, ed.).

The practice of the present invention employs, unless otherwise indicated, conventional techniques for generation of genetically modified mice. See Marten H. Hofker and Jan van Deursen, TRANSGENIC MOUSE METHODS AND PROTOCOLS, 2nd edition (2011).

In some embodiments, the invention described herein relates to a method for adoptive immunotherapy, in which T cells are edited ex vivo by CRISPR to modulate at least one gene and subsequently administered to a patient in need thereof. In some embodiments, the CRISPR editing comprising knocking-out or knocking-down the expression of at least one target gene in the edited T cells. In some embodiments, in addition to modulating the target gene, the T cells are also edited ex vivo by CRISPR to (1) knock-in an exogenous gene encoding a chimeric antigen receptor (CAR) or a T-cell receptor (TCR), (2) knock-out or knock-down expression of an immune checkpoint receptor, (3) knock-out or knock-down expression of an endogenous TCR, (4) knock-out or knock-down expression of a human leukocyte antigen class I (HLA-I) proteins, and/or (5) knock-out or knock-down expression of an endogenous gene encoding an antigen targeted by an exogenous CAR or TCR.

In some embodiments, the T cells are contacted ex vivo with an adeno-associated virus (AAV) vector encoding a CRISPR effector protein, and a guide molecule comprising a guide sequence hybridizable to a target sequence, a tracr mate sequence, and a tracr sequence hybridizable to the tracr mate sequence. In some embodiments, the T cells are contacted ex vivo (e.g., by electroporation) with a ribonucleoprotein (RNP) comprising a CRISPR effector protein complexed with a guide molecule, wherein the guide molecule comprising a guide sequence hybridizable to a target sequence, a tracr mate sequence, and a tracr sequence hybridizable to the tracr mate sequence. See Rupp et al., Scientific Reports 7:737 (2017); Liu et al., Cell Research 27:154-157 (2017). In some embodiments, the T cells are contacted ex vivo (e.g., by electroporation) with an mRNA encoding a CRISPR effector protein, and a guide molecule comprising a guide sequence hybridizable to a target sequence, a tracr mate sequence, and a tracr sequence hybridizable to the tracr mate sequence. See Eyquem et al., Nature 543:113-117 (2017). In some embodiments, the T cells are not contacted ex vivo with a lentivirus or retrovirus vector.

In some embodiments, the method comprises editing T cells ex vivo by CRISPR to knock-in an exogenous gene encoding a CAR, thereby allowing the edited T cells to recognize cancer cells based on the expression of specific proteins located on the cell surface. In some embodiments, T cells are edited ex vivo by CRISPR to knock-in an exogenous gene encoding a TCR, thereby allowing the edited T cells to recognize proteins derived from either the surface or inside of the cancer cells. In some embodiments, the method comprising providing an exogenous CAR-encoding or TCR-encoding sequence as a donor sequence, which can be integrated by homology-directed repair (HDR) into a genomic locus targeted by a CRISPR guide sequence. In some embodiments, targeting the exogenous CAR or TCR to an endogenous TCR a constant (TRAC) locus can reduce tonic CAR signaling and facilitate effective internalization and re-expression of the CAR following single or repeated exposure to antigen, thereby delaying effector T-cell differentiation and exhaustion. See Eyquem et al., Nature 543:113-117 (2017).

In some embodiments, the method comprises editing T cells ex vivo by CRISPR to block one or more immune checkpoint receptors to reduce immunosuppression by cancer cells. In some embodiments, T cells are edited ex vivo by CRISPR to knock-out or knock-down an endogenous gene involved in the programmed death-1 (PD-1) signaling pathway, such as PD-1 and PD-L1. In some embodiments, T cells are edited ex vivo by CRISPR to mutate the Pdcdl locus or the CD274 locus. In some embodiments, T cells are edited ex vivo by CRISPR using one or more guide sequences targeting the first exon of PD-1. See Rupp et al., Scientific Reports 7:737 (2017); Liu et al., Cell Research 27:154-157 (2017).

In some embodiments, the method comprises editing T cells ex vivo by CRISPR to eliminate potential alloreactive TCRs to allow allogeneic adoptive transfer. In some embodiments, T cells are edited ex vivo by CRISPR to knock-out or knock-down an endogenous gene encoding a TCR (e.g., an ap TCR) to avoid graft-versus-host-disease (GVHD). In some embodiments, T cells are edited ex vivo by CRISPR to mutate the TRAC locus. In some embodiments, T cells are edited ex vivo by CRISPR using one or more guide sequences targeting the first exon of TRAC. See Liu et al., Cell Research 27:154-157 (2017). In some embodiments, the method comprises use of CRISPR to knock-in an exogenous gene encoding a CAR or a TCR into the TRAC locus, while simultaneously knocking-out the endogenous TCR (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous TCR promoter.

In some embodiments, the method comprises editing T cells ex vivo by CRISPR to knock-out or knock-down an endogenous gene encoding an HLA-I protein to minimize immunogenicity of the edited T cells. In some embodiments, T cells are edited ex vivo by CRISPR to mutate the beta-2 microglobulin (B2M) locus. In some embodiments, T cells are edited ex vivo by CRISPR using one or more guide sequences targeting the first exon of B2M. See Liu et al., CellResearch 27:154-157 (2017). In some embodiments, the method comprises use of CRISPR to knock-in an exogenous gene encoding a CAR or a TCR into the B2M locus, while simultaneously knocking-out the endogenous B2M (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous B2M promoter.

In some embodiments, the method comprises editing T cells ex vivo by CRISPR to knock-out or knock-down an endogenous gene encoding an antigen targeted by an exogenous CAR or TCR. In some embodiments, the T cells are edited ex vivo by CRISPR to knock-out or knock-down the expression of a tumor antigen selected from human telomerase reverse transcriptase (hTERT), survivin, mouse double minute 2 homolog (MDM2), cytochrome P450 1B 1 (CYP1B), HER2/neu, Wilms' tumor gene 1 (WT1), livin, alphafetoprotein (AFP), carcinoembryonic antigen (CEA), mucin 16 (MUC16), MUC1, prostate-specific membrane antigen (PSMA), p53 or cyclin (DI) (see WO2016/011210). In some embodiments, the T cells are edited ex vivo by CRISPR to knock-out or knock-down the expression of an antigen selected from B cell maturation antigen (BCMA), transmembrane activator and CAML Interactor (TACI), or B-cell activating factor receptor (BAFF-R), CD38, CD138, CS-1, CD33, CD26, CD30, CD53, CD92, CD100, CD148, CD150, CD200, CD261, CD262, or CD362 (see WO2017/011804).

Gene Drives

The present invention also contemplates use of the CRISPR-Cas system described herein to provide RNA-guided gene drives, for example in systems analogous to gene drives described in PCT Patent Publication WO 2015/105928. Systems of this kind may for example provide methods for altering eukaryotic germline cells, by introducing into the germline cell a nucleic acid sequence encoding an RNA-guided DNA nuclease and one or more guide RNAs. The guide RNAs may be designed to be complementary to one or more target locations on genomic DNA of the germline cell. The nucleic acid sequence encoding the RNA guided DNA nuclease and the nucleic acid sequence encoding the guide RNAs may be provided on constructs between flanking sequences, with promoters arranged such that the germline cell may express the RNA guided DNA nuclease and the guide RNAs, together with any desired cargo-encoding sequences that are also situated between the flanking sequences. The flanking sequences will typically include a sequence which is identical to a corresponding sequence on a selected target chromosome, so that the flanking sequences work with the components encoded by the construct to facilitate insertion of the foreign nucleic acid construct sequences into genomic DNA at a target cut site by mechanisms such as homologous recombination, to render the germline cell homozygous for the foreign nucleic acid sequence. In this way, gene-drive systems are capable of introgressing desired cargo genes throughout a breeding population (Gantz et al., 2015, Highly efficient Cas9-mediated gene drive for population modification of the malaria vector mosquito *Anopheles stephensi*, PNAS 2015, published ahead of print Nov. 23, 2015, doi:10.1073/pnas.1521077112; Esvelt et al., 2014, Concerning RNA-guided gene drives for the alteration of wild populations eLife 2014;3:e03401). In select embodiments, target sequences may be selected which have few potential off-target sites in a genome. Targeting multiple sites within a target locus, using multiple guide RNAs, may increase the cutting frequency and hinder the evolution of drive resistant alleles. Truncated guide RNAs may reduce off-target cutting. Paired nickases may be used instead of a single nuclease, to further increase specificity. Gene drive constructs may include cargo sequences encoding transcriptional regulators, for example to activate homologous recombination genes and/or repress non-homologous end-joining. Target sites may be chosen within an essential gene, so that non-homologous end-joining events may cause lethality rather than creating a drive-resistant allele. The gene drive constructs can be engineered to function in a range of hosts at a range of temperatures (Cho et al. 2013, Rapid and Tunable Control of Protein Stability in *Caenorhabditis elegans* Using a Small Molecule, PLoS ONE 8(8): e72393. doi:10.1371/journal.pone.0072393).

Xenotransplantation

The present invention also contemplates use of the CRISPR-Cas system described herein to provide RNA-guided DNA nucleases adapted to be used to provide modified tissues for transplantation. For example, RNA-guided DNA nucleases may be used to knockout, knockdown or disrupt selected genes in an animal, such as a transgenic pig (such as the human heme oxygenase-1 transgenic pig line), for example by disrupting expression of genes that encode epitopes recognized by the human immune system, i.e. xenoantigen genes. Candidate porcine genes for disruption may for example include a(1,3)-galactosyltransferase and cytidine monophosphate-N-acetylneuraminic acid hydroxylase genes (see PCT Patent Publication WO 2014/066505). In addition, genes encoding endogenous retroviruses may be disrupted, for example the genes encoding all porcine endogenous retroviruses (see Yang et al., 2015, Genome-wide inactivation of porcine endogenous retroviruses (PERVs), Science 27 Nov. 2015: Vol. 350 no. 6264 pp. 1101-1104). In addition, RNA-guided DNA nucleases may be used to target a site for integration of additional genes in xenotransplant donor animals, such as a human CD55 gene to improve protection against hyperacute rejection.

General Gene Therapy Considerations

Examples of disease-associated genes and polynucleotides and disease specific information is available from McKusick-Nathans Institute of Genetic Medicine, Johns Hopkins University (Baltimore, Md.) and National Center for Biotechnology Information, National Library of Medicine (Bethesda, Md.), available on the World Wide Web.

Mutations in these genes and pathways can result in production of improper proteins or proteins in improper amounts which affect function. Further examples of genes, diseases and proteins are hereby incorporated by reference from U.S. Provisional application 61/736,527 filed Dec. 12, 2012. Such genes, proteins and pathways may be the target polynucleotide of a CRISPR complex of the present invention. Examples of disease-associated genes and polynucleotides are listed in Tables 20 and 21 Examples of signaling biochemical pathway-associated genes and polynucleotides are listed in Table 22.

TABLE 20

| DISEASE/<br>DISORDERS | GENE(S) |
|---|---|
| Neoplasia | PTEN; ATM; ATR; EGFR; ERBB2; ERBB3; ERBB4; Notch1; Notch2; Notch3; Notch4; AKT; AKT2; AKT3; HIF; HIF1a; HIF3a; Met; HRG; Bcl2; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bcl2; caspases family (9 members: 1, 2, 3, 4, 6, 7, 8, 9, 12); Kras; Apc |
| Age-related Macular Degeneration | Abcr; Ccl2; Cc2; cp (ceruloplasmin); Timp3; cathepsinD; Vldlr; Ccr2 |
| Schizophrenia Disorders | Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b 5-HTT (Slc6a4); COMT; DRD (Drd1a); SLC6A3; DAOA; DTNBP1; Dao (Dao1) |
| Trinucleotide Repeat Disorders | HTT (Huntington's Dx); SBMA/SMAX1/AR (Kennedy's Dx); FWX25 (Friedrich's Ataxia); ATX3 (Machado-Joseph's Dx); ATXN1 and ATXN2 (spinocerebellar ataxias); DMPK (myotonic dystrophy); Atrophin-1 and Atn1 (DRPLA Dx); CBP (Creb-BP-global instability); VLDLR (Alzheimer's); Atxn7; Atxn10 |
| Fragile X Syndrome | FMR2; FXR1; FXR2; mGLUR5 |
| Secretase Related Disorders | APH-1 (alpha and beta); Presenilin (Psen1); nicastrin (Ncstn); PEN-2 |
| Others | Nos1; Parp1; Nat1; Nat2 |
| Prion-related disorders | Prp |
| ALS | SOD1; ALS2; STEX; FUS; TARDBP; VEGF (VEGF-a; VEGF-b; VEGF-c) |
| Drug addiction | Prkce (alcohol); Drd2; Drd4; ABAT (alcohol); GRIA2; Grm5; Grin1; Htr1b; Grin2a; Drd3; Pdyn; Gria1 (alcohol) |
| Autism | Mecp2; BZRAP1; MDGA2; Sema5A; Neurexin 1; Fragile X (FMR2 (AFF2); FXR1; FXR2; Mglur5) |
| Alzheimer's Disease | E1; CHIP; UCH; UBB; Tau; LRP; PICALM; Clusterin; PS1; SORL1; CR1; Vldlr; Uba1; Uba3; CHIP28 (Aqp1, Aquaporin 1); Uchl1; Uchl3; APP |
| Inflammation | IL-10; IL-1 (IL-1a; IL-1b); IL-13; IL-17 (IL-17a (CTLA8); IL-17b; IL-17c; IL-17d; IL-17f); |

TABLE 20-continued

| DISEASE/ DISORDERS | GENE(S) |
|---|---|
|  | Il-23; Cx3cr1; ptpn22; TNFa; NOD2/CARD15 for IBD; IL-6; IL-12 (IL-12a; IL-12b); CTLA4; Cx3cl1 |
| Parkinson's Disease | x-Synuclein; DJ-1; LRRK2; Parkin; PINK1 |

TABLE 21

| | |
|---|---|
| Blood and coagulation diseases and disorders | Anemia (CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT); Bare lymphocyte syndrome (TAPBP, TPSN, TAP2, ABCB3, PSF2, RING11, MHC2TA, C2TA, RFX5, RFXAP, RFX5), Bleeding disorders (TBXA2R, P2RX1, P2X1); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, FLJ34064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, KIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1). |
| Cell dysregulation and oncology diseases and disorders | B-cell non-Hodgkin lymphoma (BCL7A, BCL7); Leukemia (TAL1, TCL5, SCL, TAL2, FLT3, NBS1, NBS, ZNFN1A1, IK1, LYF1, HOXD4, HOX4B, BCR, CML, PHL, ALL, ARNT, KRAS2, RASK2, GMPS, AF10, ARHGEF12, LARG, KIAA0382, CALM, CLTH, CEBPA, CEBP, CHIC2, BTL, FLT3, KIT, PBT, LPP, NPM1, NUP214, D9546E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9S46E, CAN, CAIN). |
| Inflammation and immune related diseases and disorders | AIDS (KIR3DL1, NKAT3, NKB1, AMB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D17S136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD40LG, HIGM1, IGM, FOXP3, IPEX, AIID, XPID, PIDX, TNFRSF14B, TACI); Inflammation (IL-10, IL-1 (IL-1a, IL-1b), IL-13, IL-17 (IL-17a (CTLA8), IL-17b, IL-17c, IL-17d, IL-17f), Il-23, Cx3cr1, ptpn22, TNFa, NOD2/CARD15 for IBD, IL-6, IL-12 (IL-12a, IL-12b), CTLA4, Cx3cl1); Severe combined immunodeficiencies (SCIDs)(JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4). |
| Metabolic, liver, kidney and protein diseases and disorders | Amyloid neuropathy (TTR, PALB); Amyloidosis (APOA1, APP, AAA, CVAP, AD1, GSN, FGA, LYZ, TTR, PALB); Cirrhosis (KRT18, KRT8, CIRH1A, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPB, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD1, PKD2, PKD4, PKDTS, PRKCSH, G19P1, PCLD, SEC63). |
| Muscular/Skeletal diseases and disorders | Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, LAMA2, LAMM, LARGE, KIAA0609, MDC1D, FCMD, TTID, MYOT, CAPN3, CANP3, DYSF, LGMD2B, SCGG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1); Osteopetrosis (LRP5, BMND1, LRP7, LR3, OPPG, VBCH2, CLCN7, CLC7, OPTA2, OSTM1, GL, TCIRG1, TIRC7, OC116, OPTB1); Muscular atrophy (VAPB, VAPC, ALS8, SMN1, SMA1, SMA2, SMA3, SMA4, BSCL2, SPG17, GARS, SMAD1, |

TABLE 21-continued

| | |
|---|---|
| Neurological and neuronal diseases and disorders | CMT2D, HEXB, IGHMBP2, SMUBP2, CATF1, SMARD1). ALS (SOD1, ALS2, STEX, FUS, TARDBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCP1, ACE1, MPO, PACIP1, PAXIP1L, PTIP, A2M, BLMH, BMH, PSEN1, AD3); Autism (Mecp2, BZRAP1, MDGA2, Sema5A, Neurexin 1, GLO1, MECP2, RTT, PPMX, MRX16, MRX79, NLGN3, NLGN4, KIAA1260, AUTSX2); Fragile X Syndrome (FMR2, FXR1, FXR2, mGLUR5); Huntington's disease and disease like disorders (HD, IT15, PRNP, PRIP, JPH3, JP3, HDL2, TBP, SCA17); Parkinson disease (NR4A2, NURR1, NOT, TINUR, SNCAIP, TBP, SCA17, SNCA, NACP, PARK1, PARK4, DJ1, PARK7, LRRK2, PARK8, PINK1, PARK6, UCHL1, PARK5, SNCA, NACP, PARK1, PARK4, PRKN, PARK2, PDJ, DBH, NDUFV2); Rett syndrome (MECP2, RTT, PPMX, MRX16, MRX79, CDKL5, STK9, MECP2, RTT, PPMX, MRX16, MRX79, x-Synuclein, DJ-1); Schizophrenia (Neuregulin1 (Nrg1), Erb4 (receptor for Neuregulin), Complexin1 (Cplx1), Tph1 Tryptophan hydroxylase, Tph2, Tryptophan hydroxylase 2, Neurexin 1, GSK3, GSK3a, GSK3b, 5-HTT (Slc6a4), COMT, DRD (Drd1a), SLC6A3, DAOA, DTNBP1, Dao (Dao1)); Secretase Related Disorders (APH-1 (alpha and beta), Presenilin (Psen1), nicastrin, (Ncstn), PEN-2, Nos1, Parp1, Nat1, Nat2); Trinucleotide Repeat Disorders (HTT (Huntington's Dx), SBMA/SMAX1/AR (Kennedy's Dx), FWX25 (Friedrich's Ataxia), ATX3 (Machado-Joseph's Dx), ATXN1 and ATXN2 (spinocerebellar ataxias), DMPK (myotonic dystrophy), Atrophin-1 and Atn1 (DRPLA Dx), CBP (Creb-BP-global instability), VLDLR (Alzheimer's), Atxn7, Atxn10). |
| Occular diseases and disorders | Age-related macular degeneration (Abcr, Ccl2, Cc2, cp (ceruloplasmin), Timp3, cathepsinD, Vldlr, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQP0, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOA1, TGFBI, CSD2, CDGG1, CSD, BIGH3, CDG2, TACSTD2, TROP2, M1S1, VSX1, RINX, PPCD, PPD, KTCN, COL8A2, FECD, PPCD2, PIP5K3, CFD); Cornea plana congenital (KERA, CNA2); Glaucoma (MYOC, TIGR, GLC1A, JOAG, GPOA, OPTN, GLC1E, FIP2, HYPL, NRP, CYP1B1, GLC3A, OPA1, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2). |

TABLE 22

| CELLULAR FUNCTION | GENES |
|---|---|
| PI3K/AKT Signaling | PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB; DYRK1A; CDKN1A; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1 |
| ERK/MAPK Signaling | PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK |
| Glucocorticoid Receptor Signaling | RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; |

TABLE 22-continued

| CELLULAR FUNCTION | GENES |
|---|---|
| Axonal Guidance Signaling | PIK3R1; CHUK; STAT3; MAP2K1; NFKB1; TGFBR1; ESR1; SMAD4; CEBPB; JUN; AR; AKT3; CCL2; MMP1; STAT1; IL6; HSP90AA1 PRKCE; ITGAM; ROCK1; ITGA5; CXCR4; ADAM12; IGF1; RAC1; RAP1A; EIF4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA |
| Ephrin Receptor Signaling | PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK |
| Actin Cytoskeleton Signaling | ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK |
| Huntington's Disease Signaling | PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKCI; HSPA5; REST; GNAQ; PIK3CB; PIK3C3; MAPK8; IGF1R; PRKD1; GNB2L1; BCL2L1; CAPN1; MAPK3; CASP8; HDAC2; HDAC7A; PRKCD; HDAC11; |

TABLE 22-continued

| CELLULAR FUNCTION | GENES |
|---|---|
| | MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3 |
| Apoptosis Signaling | PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1 |
| B Cell Receptor Signaling | RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1 |
| Leukocyte Extravasation Signaling | ACTN4; CD44; PRKCE; ITGAM; ROCK1; CXCR4; CYBA; RAC1; RAP1A; PRKCZ; ROCK2; RAC2; PTPN11; MMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; F11R; ITK; CRKL; VAV3; CTTN; PRKCA; MMP1; MMP9 |
| Integrin Signaling | ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3 |
| Acute Phase Response Signaling | IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; |

TABLE 22-continued

| CELLULAR FUNCTION | GENES |
|---|---|
| | MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6 |
| PTEN Signaling | ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1 |
| p53 Signaling | PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS1; ATR; BCL2L1; E2F1; PMAIP1; CHEK2; TNFRSF10B; TP73; RB1; HDAC9; CDK2; PIK3C2A; MAPK14; TP53; LRDD; CDKN1A; HIPK2; AKT1; PIK3R1; RRM2B; APAF1; CTNNB1; SIRT1; CCND1; PRKDC; ATM; SFN; CDKN2A; JUN; SNAI2; GSK3B; BAX; AKT3 |
| Aryl Hydrocarbon Receptor Signaling | HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F1; MAPK3; NRIP1; CHEK2; RELA; TP73; GSTP1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1 |
| Xenobiotic Metabolism Signaling | PRKCE; EP300; PRKCZ; RXRA; MAPK1; NQO1; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1 |
| SAPK/JNK Signaling | PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; |

| CELLULAR FUNCTION | GENES |
|---|---|
| | PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK |
| PPAr/RXR Signaling | PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP90AA1; ADIPOQ |
| NF-KB Signaling | IRAK1; EIF2AK2; EP300; INS; MYD88; PRKCZ; TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1 |
| Neuregulin Signaling | ERBB4; PRKCE; ITGAM; ITGA5; PTEN; PRKCZ; ELK1; MAPK1; PTPN11; AKT2; EGFR; ERBB2; PRKCI; CDKN1B; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RPS6KB1 |
| Wnt & Beta catenin Signaling | CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2 |
| Insulin Receptor Signaling | PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; |

TABLE 22-continued

| CELLULAR FUNCTION | GENES |
|---|---|
| IL-6 Signaling | GSK3A; FRAP1; CRKL; GSK3B; AKT3; FOXO1; SGK; RPS6KB1 HSPB1; TRAF6; MAPKAPK2; ELK1; MAPK1; PTPN11; IKBKB; FOS; NFKB2; MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6 |
| Hepatic Cholestasis | PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF1; FGFR4; JUN; IL1R1; PRKCA; IL6 |
| IGF-1 Signaling | IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1 |
| NRF2-mediated Oxidative Stress Response | PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPM; JUN; KEAP1; GSK3B; ATF4; PRKCA; EIF2AK3; HSP90AA1 |
| Hepatic Fibrosis/Hepatic Stellate Cell Activation | EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MIMP1; STAT1; IL6; CTGF; MMP9 |
| PPAR Signaling | EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1 |
| Fc Epsilon RI Signaling | PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; |
| G-Protein Coupled Receptor Signaling | MAPK9; PIK3C2A; BTK; MAPK14; TNF; RAF1; FYN; MAP2K2; AKT1; PIK3R1; PDPK1; MAP2K1; AKT3; VAV3; PRKCA PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA |
| Inositol Phosphate Metabolism | PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK |
| PDGF Signaling | EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 |
| VEGF Signaling | ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA |
| Natural Killer Cell Signaling | PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA |
| Cell Cycle: G1/S Checkpoint Regulation | HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6 |
| T Cell Receptor Signaling | RAC1; ELK1; MAPK1; IKBKB; CBL; PIK3CA; FOS; NFKB2; PIK3CB; PIK3C3; MAPK8; MAPK3; KRAS; RELA; PIK3C2A; BTK; LCK; RAF1; IKBKG; RELB; FYN; MAP2K2; PIK3R1; CHUK; MAP2K1; NFKB1; ITK; BCL10; JUN; VAV3 |
| Death Receptor Signaling | CRADD; HSPB1; BID; BIRC4; TBK1; IKBKB; FADD; FAS; NFKB2; BCL2; MAP3K14; MAPK8; RIPK1; CASP8; |

TABLE 22-continued

| CELLULAR FUNCTION | GENES |
|---|---|
| | DAXX; TNFRSF10B; RELA; TRAF2; TNF; IKBKG; RELB; CASP9; CHUK; APAF1; NFKB1; CASP2; BIRC2; CASP3; BIRC3 |
| FGF Signaling | RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF |
| GM-CSF Signaling | LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1 |
| Amyotrophic Lateral Sclerosis Signaling | BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 |
| JAK/Stat Signaling | PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1 |
| Nicotinate and Nicotinamide Metabolism | PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK |
| Chemokine Signaling | CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA |
| IL-2 Signaling | ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3 |
| Synaptic Long Term Depression | PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA |
| Estrogen Receptor Signaling | TAF4B; EP300; CARM1; PCAF; MAPK1; NCOR2; SMARCA4; MAPK3; NRIP1; KRAS; SRC; NR3C1; HDAC3; PPARGC1A; RBM9; |

TABLE 22-continued

| CELLULAR FUNCTION | GENES |
|---|---|
| | NCOA3; RAF1; CREBBP; MAP2K2; NCOA2; MAP2K1; PRKDC; ESR1; ESR2 |
| Protein Ubiquitination Pathway | TRAF6; SMURF1; BIRC4; BRCA1; UCHL1; NEDD4; CBL; UBE2I; BTRC; HSPA5; USP7; USP10; FBW7; USP9X; STUB1; USP22; B2M; BIRC2; PARK2; USP8; USP1; VHL; HSP90AA1; BIRC3 |
| IL-10 Signaling | TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6 |
| VDR/RXR Activation | PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA |
| TGF-beta Signaling | EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5 |
| Toll-like Receptor Signaling | IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN |
| p38 MAPK Signaling | HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1 |
| Neurotrophin/TRK Signaling | NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4 |
| FXR/RXR Activation | INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1 |
| Synaptic Long Term Potentiation | PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA |
| Calcium Signaling | RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6 |
| EGF Signaling | ELK1; MAPK1; EGFR; PIK3CA; FOS; PIK3CB; PIK3C3; MAPK8; MAPK3; PIK3C2A; RAF1; JAK1; PIK3R1; |

TABLE 22-continued

| CELLULAR FUNCTION | GENES |
|---|---|
| | STAT3; MAP2K1; JUN; PRKCA; SRF; STAT1 |
| Hypoxia Signaling in the Cardiovascular System | EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; HSP90AA1 |
| LPS/IL-1 Mediated Inhibition of RXR Function | IRAK1; MYD88; TRAF6; PPARA; RXRA; ABCA1; MAPK8; ALDH1A1; GSTP1; MAPK9; ABCB1; TRAF2; TLR4; TNF; MAP3K7; NR1H2; SREBF1; JUN; IL1R1 |
| LXR/RXR Activation | FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MMP9 |
| Amyloid Processing | PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP |
| IL-4 Signaling | AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1 |
| Cell Cycle: G2/M DNA Damage Checkpoint Regulation | EP300; PCAF; BRCA1; GADD45A; PLK1; BTRC; CHEK1; ATR; CHEK2; YWHAZ; TP53; CDKN1A; PRKDC; ATM; SFN; CDKN2A |
| Nitric Oxide Signaling in the Cardiovascular System | KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1 |
| Purine Metabolism | NME2; SMARCA4; MYH9; RRM2; ADAR; EIF2AK4; PKM2; ENTPD1; RAD51; RRM2B; TJP2; RAD51C; NT5E; POLD1; NME1 |
| cAMP-mediated Signaling | RAP1A; MAPK1; GNAS; CREB1; CAMK2A; MAPK3; SRC; RAF1; MAP2K2; STAT3; MAP2K1; BRAF; ATF4 |
| Mitochondrial Dysfunction | SOD2; MAPK8; CASP8; MAPK10; MAPK9; CASP9; PARK7; PSEN1; PARK2; APP; CASP3 |
| Notch Signaling | HES1; JAG1; NUMB; NOTCH4; ADAM17; NOTCH2; PSEN1; NOTCH3; NOTCH1; DLL4 |
| Endoplasmic Reticulum Stress Pathway | HSPA5; MAPK8; XBP1; TRAF2; ATF6; CASP9; ATF4; EIF2AK3; CASP3 |
| Pyrimidine Metabolism | NME2; AICDA; RRM2; EIF2AK4; ENTPD1; RRM2B; NT5E; POLD1; NME1 |
| Parkinson's Signaling | UCHL1; MAPK8; MAPK13; MAPK14; CASP9; PARK7; PARK2; CASP3 |
| Cardiac & Beta Adrenergic Signaling | GNAS; GNAQ; PPP2R1A; GNB2L1; PPP2CA; PPP1CC; PPP2R5C |
| Glycolysis/ Gluconeogenesis | HK2; GCK; GPI; ALDH1A1; PKM2; LDHA; HK1 |
| Interferon Signaling | IRF1; SOCS1; JAK1; JAK2; IFITM1; STAT1; IFIT3 |
| Sonic Hedgehog Signaling | ARRB2; SMO; GLI2; DYRK1A; GLI1; GSK3B; DYRK1B |
| Glycerophospholipid Metabolism | PLD1; GRN; GPAM; YWHAZ; SPHK1; SPHK2 |
| Phospholipid Degradation | PRDX6; PLD1; GRN; YWHAZ; SPHK1; SPHK2 |
| Tryptophan Metabolism | SIAH2; PRMT5; NEDD4; ALDH1A1; CYP1B1; SIAH1 |
| Lysine Degradation | SUV39H1; EHMT2; NSD1; SETD7; PPP2R5C |
| Nucleotide Excision Repair Pathway | ERCC5; ERCC4; XPA; XPC; ERCC1 |
| Starch and Sucrose Metabolism | UCHL1; HK2; GCK; GPI; HK1 |
| Aminosugars Metabolism | NQO1; HK2; GCK; HK1 |
| Arachidonic Acid Metabolism | PRDX6; GRN; YWHAZ; CYP1B1 |
| Circadian Rhythm Signaling | CSNK1E; CREB1; ATF4; NR1D1 |
| Coagulation System | BDKRB1; F2R; SERPINE1; F3 |
| Dopamine Receptor Signaling | PPP2R1A; PPP2CA; PPP1CC; PPP2R5C |
| Glutathione Metabolism | IDH2; GSTP1; ANPEP; IDH1 |
| Glycerolipid Metabolism | ALDH1A1; GPAM; SPHK1; SPHK2 |
| Linoleic Acid Metabolism | PRDX6; GRN; YWHAZ; CYP1B1 |
| Methionine Metabolism | DNMT1; DNMT3B; AHCY; DNMT3A |
| Pyruvate Metabolism | GLO1; ALDH1A1; PKM2; LDHA |
| Arginine and Proline Metabolism | ALDH1A1; NOS3; NOS2A |
| Eicosanoid Signaling | PRDX6; GRN; YWHAZ |
| Fructose and Mannose Metabolism | HK2; GCK; HK1 |
| Galactose Metabolism | HK2; GCK; HK1 |
| Stilbene, Coumarine and Lignin Biosynthesis | PRDX6; PRDX1; TYR |
| Antigen Presentation Pathway | CALR; B2M |
| Biosynthesis of Steroids | NQO1; DHCR7 |
| Butanoate Metabolism | ALDH1A1; NLGN1 |
| Citrate Cycle | IDH2; IDH1 |
| Fatty Acid Metabolism | ALDH1A1; CYP1B1 |
| Glycerophospholipid Metabolism | PRDX6; CHKA |
| Histidine Metabolism | PRMT5; ALDH1A1 |
| Inositol Metabolism | ERO1L; APEX1 |
| Metabolism of Xenobiotics by Cytochrome p450 | GSTP1; CYP1B1 |
| Methane Metabolism | PRDX6; PRDX1 |
| Phenylalanine Metabolism | PRDX6; PRDX1 |
| Propanoate Metabolism | ALDH1A1; LDHA |
| Selenoamino Acid Metabolism | PRMT5; AHCY |
| Sphingolipid Metabolism | SPHK1; SPHK2 |
| Aminophosphonate Metabolism | PRMT5 |
| Androgen and Estrogen Metabolism | PRMT5 |
| Ascorbate and Aldarate Metabolism | ALDH1A1 |
| Bile Acid Biosynthesis | ALDH1A1 |
| Cysteine Metabolism | LDHA |
| Fatty Acid Biosynthesis | FASN |
| Glutamate Receptor Signaling | GNB2L1 |
| NRF2-mediated Oxidative Stress Response | PRDX1 |
| Pentose Phosphate Pathway | GPI |
| Pentose and Glucuronate Interconversions | UCHL1 |

TABLE 22-continued

| CELLULAR FUNCTION | GENES |
|---|---|
| Retinol Metabolism | ALDH1A1 |
| Riboflavin Metabolism | TYR |
| Tyrosine Metabolism | PRMT5, TYR |
| Ubiquinone Biosynthesis | PRMT5 |
| Valine, Leucine and Isoleucine Degradation | ALDH1A1 |
| Glycine, Serine and Threonine Metabolism | CHKA |
| Lysine Degradation | ALDH1A1 |
| Pain/Taste | TRPM5; TRPA1 |
| Pain | TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkarla; Prkar2a |
| Mitochondrial Function | AIF; CytC; SMAC (Diablo); Aifm-1; Aifm-2 |
| Developmental Neurology | BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wntl Oa; Wnt10b; Wnt16); beta-catenin; Dkk-1; Frizzled related proteins; Otx-2; Gbx2; FGF-8; Reelin; Dab1; unc-86 (Pou4f1 or Brn3a); Numb; Reln |

Embodiments of the invention also relate to methods an compositions related to knocking out genes, amplifying genes and repairing particular mutations associated with DNA repeat instability and neurological disorders (Robert D. Wells, Tetsuo Ashizawa, Genetic Instabilities and Neurological Diseases, Second Edition, Academic Press, Oct. 13, 2011—Medical). Specific aspects of tandem repeat sequences have been found to be responsible for more than twenty human diseases (New insights into repeat instability: role of RNA·DNA hybrids. McIvor EI, Polak U, Napierala M. RNA Biol. 2010 September-October;7(5):551-8). The present effector protein systems may be harnessed to correct these defects of genomic instability.

Several further aspects of the invention relate to correcting defects associated with a wide range of genetic diseases which are further described on the website of the National Institutes of Health under the topic subsection Genetic Disorders (website at health.nih.gov/topic/GeneticDisorders). The genetic brain diseases may include but are not limited to Adrenoleukodystrophy, Agenesis of the Corpus Callosum, Aicardi Syndrome, Alpers' Disease, Alzheimer's Disease, Barth Syndrome, Batten Disease, CADASIL, Cerebellar Degeneration, Fabry's Disease, Gerstmann-Straussler-Scheinker Disease, Huntington's Disease and other Triplet Repeat Disorders, Leigh's Disease, Lesch-Nyhan Syndrome, Menkes Disease, Mitochondrial Myopathies and NINDS Colpocephaly. These diseases are further described on the website of the National Institutes of Health under the subsection Genetic Brain Disorders.

Throughout this disclosure there has been mention of CRISPR or CRISPR-Cas complexes or systems. CRISPR systems or complexes can target nucleic acid molecules, e.g., CRISPR-Cas complexes can target and cleave or nick or simply sit upon a target DNA molecule (depending on if the Cas has mutations that render it a nickase or "dead"). Such systems or complexes are amenable for achieving tissue-specific and temporally controlled targeted deletion of candidate disease genes. Examples include but are not limited to genes involved in cholesterol and fatty acid metabolism, amyloid diseases, dominant negative diseases, latent viral infections, among other disorders. Accordingly, target sequences for such systems or complexes can be in candidate disease genes, e.g.:

TABLE 23

| Disease | GENE | SPACER | PAM | Mechanism | References |
|---|---|---|---|---|---|
| Hypercholesterolemia | HMG-CR | GCCAAATTGGACGACCCTCG (SEQ ID NO: 219) | CGG | Knockout | Fluvastatin: a review of its pharmacology and use in the management of hypercholesterolaemia. (Plosker GL et al. Drugs 1996, 51(3):433-459) |
| Hypercholesterolemia | SQLE | CGAGGAGACCCCCGTTTCGG (SEQ ID NO: 220) | TGG | Knockout | Potential role of nonstatin cholesterol lowering agents (Trapani et al. IUBMB Life, Volume 63, Issue 11, pages 964-971, November 2011) |
| Hyperlipidemia | DGAT1 | CCCGCCGCCGCCGTGGCTCG (SEQ ID NO: 221) | AGG | Knockout | DGAT1 inhibitors as anti-obesity and anti-diabetic agents. (Birch AM et al. Current Opinion in Drug Discovery & Development [2010, 13(4):489-496) |
| Leukemia | BCR-ABL | TGAGCTCTACGAGATCCACA (SEQ ID NO: 222) | AGG | Knockout | Killing of leukemic cells with a BCR/ABL fusion gene by RNA interference (RNAi). (Fuchs et al. Oncogene 2002, 21(37):5716-5724) |

Thus, the present invention, with regard to CRISPR or CRISPR-Cas complexes contemplates correction of hematopoietic disorders. For example, Severe Combined Immune Deficiency (SCID) results from a defect in lymphocytes T maturation, always associated with a functional defect in lymphocytes B (Cavazzana-Calvo et al., Annu. Rev. Med., 2005, 56, 585-602; Fischer et al., Immunol. Rev., 2005, 203, 98-109). In the case of Adenosine Deaminase (ADA) deficiency, one of the SCID forms, patients can be treated by injection of recombinant Adenosine Deaminase enzyme. Since the ADA gene has been shown to be mutated in SCID patients (Giblett et al., Lancet, 1972, 2, 1067-1069), several other genes involved in SCID have been identified (Cavazzana-Calvo et al., Annu. Rev. Med., 2005, 56, 585-602; Fischer et al., Immunol. Rev., 2005, 203, 98-109). There are four major causes for SCID: (i) the most frequent form of SCID, SCID-X1 (X-linked SCID or X-SCID), is caused by mutation in the IL2RG gene, resulting in the absence of mature T lymphocytes and NK cells. IL2RG encodes the gamma C protein (Noguchi, et al., Cell, 1993, 73, 147-157), a common component of at least five interleukin receptor complexes. These receptors activate several targets through the JAK3 kinase (Macchi et al., Nature, 1995, 377, 65-68), which inactivation results in the same syndrome as gamma C inactivation; (ii) mutation in the ADA gene results in a defect in purine metabolism that is lethal for lymphocyte precursors, which in turn results in the quasi absence of B, T and NK cells; (iii) V(D)J recombination is an essential step in the maturation of immunoglobulins and T lymphocytes receptors (TCRs). Mutations in Recombination Activating Gene 1 and 2 (RAG1 and RAG2) and Artemis, three genes involved in this process, result in the absence of mature T and B lymphocytes; and (iv) Mutations in other genes such as CD45, involved in T cell specific signaling have also been reported, although they represent a minority of cases (Cavazzana-Calvo et al., Annu. Rev. Med., 2005, 56, 585-602; Fischer et al., Immunol. Rev., 2005, 203, 98-109). In aspect of the invention, relating to CRISPR or CRISPR-Cas complexes contemplates system, the invention contemplates that it may be used to correct ocular defects that arise from several genetic mutations further described in Genetic Diseases of the Eye, Second Edition, edited by Elias I. Traboulsi, Oxford University Press, 2012. Non-limiting examples of ocular defects to be corrected include macular degeneration (MD), retinitis pigmentosa (RP). Non-limiting examples of genes and proteins associated with ocular defects include but are not limited to the following proteins: (ABCA4) ATP-binding cassette, sub-family A (ABC1), member 4 ACHM1 achromatopsia (rod monochromacy) 1 ApoE Apolipoprotein E (ApoE) C1QTNF5 (CTRP5) C1q and tumor necrosis factor related protein 5 (C1QTNF5) C2 Complement component 2 (C2) C3 Complement components (C3) CCL2 Chemokine (C-C motif) Ligand 2 (CCL2) CCR2 Chemokine (C-C motif) receptor 2 (CCR2) CD36 Cluster of Differentiation 36 CFB Complement factor B CFH Complement factor CFH H CFHR1 complement factor H-related 1 CFHR3 complement factor H-related 3 CNGB3 cyclic nucleotide gated channel beta 3 CP ceruloplasmin (CP) CRP C reactive protein (CRP) CST3 cystatin C or cystatin 3 (CST3) CTSD Cathepsin D (CTSD) CX3CR1 chemokine (C-X3-C motif) receptor 1 ELOVL4 Elongation of very long chain fatty acids 4 ERCC6 excision repair cross-complementing rodent repair deficiency, complementation group 6 FBLN5 Fibulin-5 FBLN5 Fibulin 5 FBLN6 Fibulin 6 FSCN2 fascin (FSCN2) HMCN1 Hemicentrin 1 HMCN1 hemicentin 1 HTRA1 HtrA serine peptidase 1 (HTRA1) HTRA1 HtrA serine peptidase 1 IL-6 Interleukin 6 IL-8 Interleukin 8 LOC387715 Hypothetical protein PLEKHA1 Pleckstrin homology domain-containing family A member 1 (PLEKHA1) PROM1 Prominin 1(PROM1 or CD133) PRPH2 Peripherin-2 RPGR retinitis pigmentosa GTPase regulator SERPING1 serpin peptidase inhibitor, clade G, member 1 (C1-inhibitor) TCOF1 Treacle TIMP3 Metalloproteinase inhibitor 3 (TIMP3) TLR3 Toll-like receptor 3 The present invention, with regard to CRISPR or CRISPR-Cas complexes contemplates also contemplates delivering to the heart. For the heart, a myocardium tropic adena-associated virus (AAVM) is preferred, in particular AAVM41 which showed preferential gene transfer in the heart (see, e.g., Lin-Yanga et al., PNAS, Mar. 10, 2009, vol. 106, no. 10). For example, US Patent Publication No. 20110023139, describes use of zinc finger nucleases to genetically modify cells, animals and proteins associated with cardiovascular disease. Cardiovascular diseases generally include high blood pressure, heart attacks, heart failure, and stroke and TIA. By way of example, the chromosomal sequence may comprise, but is not limited to, IL1B (interleukin 1, beta), XDH (xanthine dehydrogenase), TP53 (tumor protein p53), PTGIS (prostaglandin I2 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin I2 (prostacyclin) receptor (IP)), KCNJ11 (potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPN5 (calpain 5), PARP14 (poly (ADP-ribose) polymerase family, member 14), MEX3C (mex-3 homolog C (C. elegans)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, C1Q and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C-C motif) ligand 2), LPL (lipoprotein lipase), VWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3 (coagulation factor III (thromboplastin, tissue factor)), CST3 (cystatin C), COG2 (component of oligomeric golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK1 (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein 111a, antigen CD61)), CAT (catalase), UTS2 (urotensin 2), THBD (thrombomodulin), F10 (coagulation factor X), CP (ceruloplasmin (ferroxidase)), TNFRSF11 B (tumor necrosis factor receptor superfamily, member 11 b), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, sub-family B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C-C motif) receptor 5), MMP 1 (matrix metallopeptidase 1 (interstitial collagenase)), TIMP1 (TIMP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysin 1, progelatinase)), ELN (elastin), USF1 (upstream transcription factor 1), CFH (complement factor H), HSPA4 (heat shock 70 kDa protein 4), MMP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-I-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C-X-C motif) receptor 4), PROC (protein C (inactivator of coagulation factors Va and VIIIa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid A1), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomerase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CABINI (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SPi (Spi transcription factor), TGIF1 (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), IL2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member Al), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IL17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, Al polypeptide), TTR (transthyretin), FABP4

(fatty acid binding protein 4, adipocyte), PON3 (paraoxonase 3), APOC1 (apolipoprotein C-I), INSR (insulin receptor), TNFRSF 1B (tumor necrosis factor receptor superfamily, member 1i), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L2 (transcription factor 7-like 2 (T-cell specific, HMG-box)), BDKRB2 (bradykinin receptor B2), NFE2L2 (nuclear factor (erythroid-derived 2)-like 2), NOTCH1 (Notch homolog 1, translocation-associated (*Drosophila*)), UGT1A1 (UDP glucuronosyltransferase 1 family, polypeptide Al), IFNA1 (interferon, alpha 1), PPARD (peroxisome proliferator-activated receptor delta), SIRT1 (sirtuin (silent mating type information regulation 2 homolog) 1 (*S. cerevisiae*)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT 1 (glutathione S-transferase theta 1), IL6ST (interleukin 6 signal transducer (gp130, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member Al (aldehyde reductase)), ALDH9A1 (aldehyde dehydrogenase 9 family, member Al), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C4B (complement component 4B (Chido blood group), P2RY12 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C3 botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMPP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin L1), PCNA (proliferating cell nuclear antigen), IGF2 (insulin-like growth factor 2 (somatomedin A)), ITGB1 (integrin, beta 1 (fibronectin receptor, beta polypeptide, antigen CD29 includes MDF2, MSK12)), CAST (calpastatin), CXCL12 (chemokine (C-X-C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), IL2RA (interleukin 2 receptor, alpha), CCL5 (chemokine (C-C motif) ligand 5), IRF1 (interferon regulatory factor 1), CFLAR (CASP8 and FADD-like apoptosis regulator), CALCA (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C-C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PECAM1 (platelet/endothelial cell adhesion molecule), CCL4 (chemokine (C-C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L1 (YME1-like 1 (*S. cerevisiae*)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-.beta.-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C-C motif) ligand 11), PGF (B321 placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Shal-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene $C_4$ synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHC1 (SHC (Src homology 2 domain containing) transforming protein 1), LRP1 (low density lipoprotein receptor-related protein 1), SOCS3 (suppressor of cytokine signaling 3), ADH1B (alcohol dehydrogenase 1B (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity IIIa, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor H1), NR1I2 (nuclear receptor subfamily 1, group I, member 2), CRH (corticotropin releasing hormone), HTR1A (5-hydroxytryptamine (serotonin) receptor 1A), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity IIa, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), C4BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C-X-C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F11 (coagulation factor XI), ATP7A (ATPase, Cu++transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCHE (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C-X-C motif) receptor 3), CD81 (CD81 molecule), SMAD7 (SMAD family member 7), LAMC2 (laminin, gamma 2), MAP3K5 (mitogen-activated protein kinase kinase kinase 5), CHGA (chromogranin A (parathyroid secretory protein 1)), IAPP (islet amyloid polypeptide), RHO (rhodopsin), ENPP1 (ectonucleotide pyrophosphatase/phosphodiesterase 1), PTHLH (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha-), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISH (cytokine inducible SH2-containing protein), GAST (gastrin), MYOC (myocilin, trabecular meshwork inducible glucocorticoid response), ATP1A2 (ATPase, Na+/K+transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), HSF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTH (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOH (apolipoprotein H (beta-2-glycoprotein I)), S100A8 (S100 calcium binding protein A8), IL11 (interleukin 11), ALOX15 (arachidonate 15-lipoxygenase), FBLN1 (fibulin 1), NR1H3 (nuclear receptor subfamily 1, group H, member 3), SCD (stearoyl-CoA desaturase (delta-9-desaturase)), GIP (gastric inhibitory polypeptide), CHGB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), HSD11B2 (hydroxysteroid (11-beta) dehydrogenase 2), CALCRL (calcitonin receptor-like), GALNT2 (UDP-N-acetyl-alpha-D-galactosamine.polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adenovirus E1B 19 kDa interacting protein 3), GCKR (glucokinase (hexokinase 4) regulator), S100A12 (S100 calcium binding protein A12), *PADI4* (peptidyl arginine deiminase, type IV), HSPA14 (heat shock 70 kDa protein 14), CXCR1 (chemokine (C-X-C motif) receptor 1), H19 (H19, imprinted maternally expressed transcript (non-protein coding)), KRTAP19-3 (keratin associated protein 19-3), IDDM2 (insulin-dependent diabetes mellitus 2), RAC2 (ras-related C3 botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNA1C (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11A (tumor necrosis factor receptor superfamily, member 11a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol(myo)-1(or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L1 (chitinase 3-like 1 (cartilage glycoprotein-39)), ALDH1B1 (aldehyde dehydrogenase 1 family, member Bi), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C-C motif) receptor 6), GJB3 (gap junction protein, beta 3, 31 kDa), IL1RL1 (interleukin 1 receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, *Drosophila*)), F 11R (F 11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), KHK (ketohexokinase (fructokinase)), SAT 1(spermidine/ spermine N1-acetyltransferase 1), GGH (gamma-glutamyl hydrolase (conjugase, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RHOB (ras homolog gene family, member B), LY96 (lymphocyte antigen 96), FOXO1 (forkhead box 01), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (*Drosophila*)), PBX4 (pre-B-cell leukemia homeobox 4), NUPR1 (nuclear protein, transcriptional regulator, 1), 15-September(15 kDa selenoprotein), CILP2 (cartilage intermediate layer protein 2), TERC (telomerase RNA component), GGT2 (gamma-glutamyltransferase 2), MT-CO1 (mitochondrially encoded cytochrome c oxidase I), and UOX (urate oxidase, pseudogene). In an additional embodiment, the chromosomal sequence may further be selected from Pon1 (paraoxonase 1), LDLR (LDL receptor), ApoE (Apolipoprotein E), Apo B-100 (Apolipoprotein B-100), ApoA (Apolipoprotein(a)), ApoA1 (Apolipoprotein A1), CBS (Cystathione B-synthase), Glycoprotein IIb/IIb, MTHRF (5,10-methylenetetrahydrofolate reductase (NADPH), and combinations thereof. In one iteration, the chromosomal sequences and proteins encoded by chromosomal sequences involved in cardiovascular disease may be chosen from CacnalC, Sod1, Pten, Ppar(alpha), Apo E, Leptin, and combinations thereof. The text herein accordingly provides exemplary targets as to CRISPR or CRISPR-Cas systems or complexes.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Research Program

The subject invention may be used as part of a research program wherein there is transmission of results or data. A computer system (or digital device) may be used to receive, transmit, display and/or store results, analyze the data and/or results, and/or produce a report of the results and/or data and/or analysis. A computer system may be understood as a logical apparatus that can read instructions from media (e.g. software) and/or network port (e.g. from the internet), which can optionally be connected to a server having fixed media. A computer system may comprise one or more of a CPU, disk drives, input devices such as keyboard and/or mouse, and a display (e.g. a monitor). Data communication, such as transmission of instructions or reports, can be achieved through a communication medium to a server at a local or a remote location. The communication medium can include any means of transmitting and/or receiving data. For example, the communication medium can be a network connection, a wireless connection, or an internet connection. Such a connection can provide for communication over the World Wide Web. It is envisioned that data relating to the present invention can be transmitted over such networks or connections (or any other suitable means for transmitting information, including but not limited to mailing a physical report, such as a print-out) for reception and/or for review by a receiver. The receiver can be but is not limited to an individual, or electronic system (e.g. one or more computers, and/or one or more servers). In some embodiments, the computer system comprises one or more processors. Processors may be associated with one or more controllers, calculation units, and/or other units of a computer system, or implanted in firmware as desired. If implemented in software, the routines may be stored in any computer readable memory such as in RAM, ROM, flash memory, a magnetic disk, a laser disk, or other suitable storage medium. Likewise, this software may be delivered to a computing device via any known delivery method including, for example, over a communication channel such as a telephone line, the internet, a wireless connection, etc., or via a transportable medium, such as a computer readable disk, flash drive, etc. The various steps may be implemented as various blocks, operations, tools, modules and techniques which, in turn, may be implemented in hardware, firmware, software, or any combination of hardware, firmware, and/or software. When implemented in hardware, some or all of the blocks, operations, techniques, etc. may be implemented in, for example, a custom integrated circuit (IC), an application specific integrated circuit (ASIC), a field programmable logic array (FPGA), a programmable logic array (PLA), etc. A client-server, relational database architecture can be used in embodiments of the invention. A client-server architecture is a network architecture in which each computer or process on the network is either a client or a server. Server computers are typically powerful computers dedicated to managing disk drives (file servers), printers (print servers), or network traffic (network servers). Client computers include PCs (personal computers) or workstations on which users run applications, as well as example output devices as disclosed herein. Client computers rely on server computers for resources, such as files, devices, and even processing power. In some embodiments of the invention, the server computer handles all of the database functionality. The client computer can have software that handles all the front-end data management and can also receive data input from users. A machine readable medium comprising computer-executable code may take many forms, including but not limited to, a tangible storage medium, a carrier wave medium or physical transmission medium. Non-volatile storage media include, for example, optical or magnetic disks, such as any of the storage devices in any computer(s) or the like, such as may be used to implement the databases, etc. shown in the drawings. Volatile storage media include dynamic memory, such as main memory of such a computer platform. Tangible transmission media include coaxial cables; copper wire and fiber optics, including the wires that comprise a bus within a computer system. Carrier-wave transmission media may take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH-EPROM, any other memory chip or cartridge, a carrier wave transporting data or instructions, cables or links transporting such a carrier wave, or any other medium from which a computer may read programming code and/or data. Many of these forms of computer readable media may be involved in carrying one or more sequences of one or more instructions to a processor for execution. Accordingly, the invention comprehends performing any method herein-discussed and storing and/or transmitting data and/or results therefrom and/or analysis thereof, as well as products from performing any method herein-discussed, including intermediates.

The present application also provides aspects and embodiments as set forth in the following numbered Statements:

Statement 1. A method of reducing immunogenicity of a Cas protein which comprises mutating one or more immunogenic T cell epitopes.

Statement 2. The method of Statement 1, wherein T cell epitopes are ordered by determining immunogenicity and one or more of the ten most immunogenic T cell epitopes are mutated.

Statement 3. The method of any one of Statement 1-2, wherein determining immunogenicity comprises measuring affinity of a peptide containing the epitope for one or more MHC molecule.

Statement 4. The method of any one of Statement 1-3, wherein determining immunogenicity comprises comparing a peptide containing the epitope to a host proteome.

Statement 5. The method of any one of Statement 1-4, which comprises mutating Cas proteins containing one or more mutations at one or more amino acid positions and screening the mutant proteins for one or more Cas activities.

Statement 6. The method of Statement 5, wherein the mutating and screening are performed using a phage display system.

Statement 7. The method of Statement 5, wherein the mutating and screening are performed using phage-assisted continuous evolution (PACE).

Statement 8. The method of any one of Statement 1-7, wherein nuclease activity of the Cas protein is preserved.

Statement 9. The method of any one of Statement 1-8, wherein one or more active site residues are unchanged.

Statement 10. The method of any one of Statement 1-9, wherein one or more residues that determine complex formation with a guide are unchanged.

Statement 11. The method of any one of Statement 1-10, wherein target specificity of a CRISPR system comprising the Cas protein is maintained or increased.

Statement 12. The method of any one of Statement 1-11, which comprises deleting, inserting, or mutating one or more amino acids in the immunogenic T cell epitope.

Statement 13. The method of any one of Statement 1-12, wherein identification of a T cell epitope comprises determining the sequence of one or more peptides from the Cas protein that bind to an MHC receptor.

Statement 14. The method of any one of Statement 1-13, wherein identification of a T cell epitope comprises comparison of the CRISPR protein to a database of peptides that bind to an MHC receptor.

Statement 15. The method of Statement 14, wherein the comparison is in silico.

Statement 16. The method of Statement 13 wherein the MHC receptor is a class I MHC receptor.

Statement 17. The method of Statement 13, wherein the MHC receptor is a class II MHC receptor.

Statement 18. The method of any one of Statement 1-17, wherein the engineered Cas protein is a class 2 Cas protein.

Statement 19. The method of any one of Statement 1-18, wherein the engineered Cas protein is Type II, Type V, or Type VI Cas protein.

Statement 20. The method of any one of Statement 1-19, wherein the Cas protein comprises Cas9, Cas12a, Cas12b, Cas13a, Cas13b, or Cas13c.

Statement 21. The method of any one of Statement 1-20, wherein the Cas protein is associated with a functional domain.

Statement 22. The method of Statement 21, wherein the functional domain comprises a mutation that reduces immunogenicity.

Statement 23. The method of Statement 21, wherein the functional domain comprises an activator, a repressor, or a DNA methylase.

Statement 24. The method of Statement 21, wherein the functional domain comprises a base editor.

Statement 25. An engineered Cas protein which comprises at least one mutated T cell epitope, wherein the T cell epitope has reduced immunogenicity as compared to the corresponding T cell epitope of a naturally occurring Cas protein, whereby the engineered Cas protein comprises reduced immunogenicity as compared to the naturally occurring Cas protein.

Statement 26. The engineered Cas protein of Statement 25, wherein immunogenicity of the T cell epitope is measured in silico.

Statement 27. The engineered Cas protein of any one of Statements 25-26, wherein the immunogenicity of the CRISPR protein is measured in a host.

Statement 28. A polypeptide comprising an engineered Cas protein having reduced immunogenicity compared to a naturally occurring Cas protein.

Statement 29. The polypeptide of Statement 28, wherein the Cas protein comprises at least one T cell epitope mutation.

Statement 30. The polypeptide of Statement 29, wherein the mutation comprises an insertion, deletion, or substitution.

Statement 31. The polypeptide of any one of Statements 28-30, wherein the Cas protein is glycosylated.

Statement 32. The polypeptide of any one of Statements 28-31, wherein the polypeptide comprises one or more nuclear localization signals (NLS).

Statement 33. The polypeptide of any one of Statements 28-32, wherein the engineered Cas protein comprises a Cas nuclease catalytic site.

Statement 34. The polypeptide of any one of Statements 28-33, wherein the engineered Cas protein is a nickase.

Statement 35. The polypeptide of any one of Statements 28-34, wherein the engineered Cas protein is catalytically inactive.

Statement 36. The polypeptide of any one of Statements 28-35, wherein the engineered Cas protein is a class 2 Cas protein.

Statement 37. The polypeptide of any one of Statements 28-36, wherein the engineered Cas protein is Type II, Type V, or Type VI Cas protein.

Statement 38. The polypeptide of any one of Statements 28-37, wherein the engineered Cas protein is Cas9, Cas12, or Cas13.

Statement 39. The polypeptide of any one of Statements 28-38, wherein the Cas protein is Cas9.

Statement 40. The polypeptide of Statement 39, wherein the Cas9 is from Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, or Campylobacter.

Statement 41. The polypeptide of any one of Statements 39-40, wherein the Cas9 comprises a mutation at D10, E762, H840, N854, N863, or D986 with reference to the position numbering of a Streptococcus pyogenes Cas9.

Statement 42. The polypeptide of Statement 41, wherein the mutation comprises D10A, E762A, H840A, N854A, N863A or D986A.

Statement 43. The polypeptide of any one of Statements 28-38, wherein the Cas protein is Cas12a.

Statement 44. The polypeptide of Statement 43, wherein the Cas12a is from Francisella tularensis 1, Prevotella albensis, Lachnospiraceae bacterium MC2017 1, Butyrivibrio proteoclasticus, Peregrinibacteria bacterium GW2011_GWA2_33_10, Parcubacteria bacterium GW2011_GWC2_44_17, Smithella sp. SCADC, Acidaminococcus sp. BV3L6, Lachnospiraceae bacterium MA2020, Candidatus Methanoplasma termitum, Eubacterium eligens, Moraxella bovoculi 237, Leptospira inadai, Lachnospiraceae bacterium ND2006, Porphyromonas crevioricanis 3, Prevotella disiens, or Porphyromonas macacae.

Statement 45. The polypeptide of any one of Statements 28-38, wherein the Cas protein is Cas12b.

Statement 46. The polypeptide of Statement 45, wherein the Cas12b is from Alicyclobacillus, Desulfovibrio, Desulfonatronum, Opitutaceae, Tuberibacillus, Bacillus, Brevibacillus, Candidatus, Desulfatirhabdium, Elusimicrobia, Citrobacter, Methylobacterium, Omnitrophicai, Phycisphaerae, Planctomycetes, Spirochaetes, or Verrucomicrobiaceae.

Statement 47. The polypeptide of Statement 45 or 46, wherein the Cas12b comprises a mutation at R911, R1000, or R1015 with reference to the position numbering of a Alicyclobacillus acidoterrestris Cas12b.

Statement 48. The polypeptide of any one of Statements 28-38, wherein the Cas protein is Cas13.

Statement 49. The polypeptide of Statement 48, wherein the Cas13 is from Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium or Acidaminococcus.

Statement 50. A nucleic acid encoding the engineered Cas protein of any one of Statements 28-49.

Statement 51. A cell comprising the nucleic acid of Statement 50.

Statement 52. A composition comprising an engineered Cas protein or a nucleotide sequence encoding the Cas protein, and at least one guide designed to form a complex with the Cas protein or at least one nucleotide sequence encoding the at least one guide, wherein the guide is designed to hybridize with a target sequence of a DNA molecule in a cell.

Statement 53. The composition of Statement 52, wherein the Cas protein is Cas9, Cas12, or Cas13.

Statement 54. The composition of any one of Statements 52-53, wherein the Cas protein comprises one or more nuclear localization signals (NLSs).

Statement 55. The composition of any one of Statements 52-54, wherein the guide comprises a chimeric RNA.

Statement 56. The composition of any one of Statements 52-55, wherein the guide comprises a crRNA and a tracrRNA.

Statement 57. The composition of any one of Statements 52-56, further comprising a homologous recombination (HR) template.

Statement 58. The composition of any one of Statements 52-57, wherein the Cas protein is associated with one or more functional domains.

Statement 59. The composition of any one of Statements 52-58, wherein the Cas protein is associated with one or more functional domains; and the Cas protein comprises one or more mutations within a RuvC and/or Nuc domain, whereby the complex can deliver an epigenetic modifier or a transcriptional or translational activation or repression signal.

Statement 60. The composition of any one of Statements 52-59, wherein the Cas protein is associated with adenosine deaminase or cytidine deaminase.

Statement 61. The composition of any one of Statements 52-60, wherein the cell is a mammalian cell.

Statement 62. The composition of any one of Statements 52-61, wherein the cell is a human cell.

Statement 63. The composition of any one of Statements 52-62, wherein the Cas protein is Cas13, and optionally the Cas13 comprises one or more mutations within an HEPN domain, such as R597A, H602A, R1278A, and/or H1283A, whereby the complex can deliver an epigenetic modifier or a transcriptional or translational activation or repression signal.

Statement 64. A vector system for providing the composition of Statements 52-63, which comprises one or more vectors comprising: a first regulatory element operably linked to a nucleotide sequence encoding a deimmunized Cas protein, and i) a) a second regulatory element operably linked to a nucleotide sequence encoding the crRNA, and b) a third regulatory element operably linked to a nucleotide sequence encoding the tracrRNA, ii) a second regulatory element operably linked to a nucleotide sequence encoding the crRNA and the tracr RNA, or iii) a second regulatory element operably linked to a nucleotide sequence encoding a guide sequence.

Statement 65. The vector system of Statement 64, wherein the nucleotide sequence encoding the Cas protein is codon optimized for expression in a eukaryotic cell.

Statement 66. The vector system of any one of Statements 64-65, wherein the one or more vectors comprise one or more viral vectors.

Statement 67. The vector system of any one of Statements 64-66, wherein the one or more vectors comprise one or more retroviral, lentiviral, adenoviral, adeno-associated or herpes simplex viral vectors.

Statement 68. A delivery system configured to deliver an engineered Cas protein having reduced immunogenicity compared to a naturally occurring Cas protein and one or more nucleic acid components of a composition comprising: a) the engineered Cas protein, and b) i) a crRNA comprising a) a 5' guide sequence designed to hybridize to a target DNA sequence, and b) a 3' direct repeat sequence, and ii) a tracr RNA, or a guide, whereby there is formed a CRISPR complex comprising the Cas protein complexed with the crRNA and the tracr RNA, or the guide.

Statement 69. The delivery system of Statement 68, wherein the Cas protein is a Type II, Type V, or Type VI Cas protein.

Statement 70. The delivery system of any one of Statements 68-69, wherein the Cas protein is Cas9, Cas12, or Cas13.

Statement 71. The delivery system of any one of Statements 68-70, which comprises one or more vectors or one or more polynucleotide molecules, the one or more vectors or polynucleotide molecules comprising one or more polynucleotide molecules encoding the Cas protein and one or more nucleic acid components of the non-naturally occurring or engineered composition.

Statement 72. The delivery system of any one of Statements 68-71, which comprises a delivery vehicle comprising liposome(s), particle(s), exosome(s), microvesicle(s), a gene-gun or one or more viral vector(s).

Statement 73. An engineered Cas protein which comprises at least one mutated T cell epitope, wherein the T cell epitope has reduced immunogenicity as compared to the corresponding T cell epitope of a naturally occurring Cas protein, whereby the engineered Cas protein comprises reduced immunogenicity as compared to the naturally occurring Cas protein.

Statement 74. The engineered Cas protein of any one of Statements 68-73, wherein the Cas protein is wherein the Cas protein is a Type II, Type V, or Type VI Cas protein.

Statement 75. The engineered Cas protein of any one of Statements 68-74, wherein the Cas protein is Cas9, Cas12, or Cas13.

Statement 76. The engineered Cas protein of any one of Statements 68-75, wherein immunogenicity of the T cell epitope is measured in silico.

Statement 77. The engineered Cas protein of any one of Statements 68-76, wherein the immunogenicity of the Cas protein is measured in a host.

Statement 78. A method of modifying a target nucleic acid, the method comprising contacting the target DNA with one or more engineered compositions comprising: a) an engineered Cas protein of any one of Statements 68-77, having reduced immunogenicity compared to a naturally occurring Cas protein, b i) a crRNA comprising a) a guide sequence designed to hybridize to the target DNA sequence, and b) a direct repeat sequence, and ii) optionally a tracr RNA, or a guide, whereby there is formed a CRISPR complex comprising the Cas protein complexed with the crRNA and, optionally, with the tracr RNA, or the guide, wherein the guide sequence directs sequence-specific binding to the target DNA sequence in a cell, whereby expression of the target locus of interest is modified.

Statement 79. The method of Statement 78, wherein modifying expression of the target gene comprises cleaving the target nucleic acid.

Statement 80. The method of any one of Statements 78-79, wherein modifying expression of the target gene comprises increasing or decreasing expression of the target nucleic acid.

Statement 81. The method of any one of Statements 78-80, wherein the target nucleic acid is DNA or RNA.

Statement 82. The method of any one of Statements 78-81, wherein the target gene is in a prokaryotic cell.

Statement 83. The method of any one of Statements 78-82, wherein the target gene is in a eukaryotic cell.

Statement 84. The method of any one of Statements 78-83, wherein the target gene is in a mammalian cell or a human cell.

Statement 85. A cell comprising a modified target of interest, wherein the target of interest has been modified according to the method of any one of Statements 78-84.

Statement 86. A method of modifying a target DNA in a mammal, which comprises delivering the system of any one of Statements 68-72.

Statement 87. The method of Statement 86, wherein the mammal is a human, a non-human primate, a canine, a feline, an bovine, a porcine, an ovine, a rat, a mouse.

Statement 88. The method of any one of Statements 86-87, which further comprises inducing tolerance to the Cas protein.

Statement 89. An engineered composition for site directed base editing comprising a targeting domain and a adenosine or cytidine deaminase, wherein the deaminase has reduced immunogenicity compared to a naturally occurring deaminase.

Statement 90. The composition of Statement 89, wherein the deaminase comprises at least one T cell epitope mutation.

Statement 91. The composition of Statement 90, wherein the mutation comprises an insertion, deletion, or substitution.

Statement 92. The composition of any of Statements 89-91, which further comprises a mutation of the targeting domain that reduces immunogenicity.

Statement 93. The composition of any of Statements 89-92, wherein the targeting domain is an oligonucleotide binding domain.

Statement 94. The composition of any of Statements 89-93, wherein the deaminase, or catalytic domain thereof, comprises one or more mutations that increase activity or specificity of the adenosine deaminase relative to wild type.

Statement 95. The composition of any of Statements 89-95, wherein the deaminase comprises one or more mutations that changes the functionality of the deaminase relative to wild type, preferably an ability of the deaminase to deaminate cytidine.

Statement 96. The composition of any of Statements 89-95, wherein the targeting domain is a CRISPR system comprising a Cas protein, or fragment thereof which retains DNA and/or RNA binding ability, and a guide molecule.

Statement 97. The composition of any of Statements 89-97, wherein the CRISPR system is catalytically inactive.

Statement 98. The composition of any of Statements 89-97, wherein the CRISPR system comprises an RNA-binding protein, preferably Cas13, preferably the Cas13 protein is Cas13a, Cas13b or Cas13c, preferably wherein said Cas13 comprises a Cas13 listed in any of Tables 4, 5, or 6 or is from a bacterial species listed in any of Tables 4, 5, or 6, preferably wherein said Cas13 protein comprises *Prevotella* sp.P5-125 Cas13b, Porphyromas *gulae* Cas13b, or *Riemerella anatipestifer* Cas13b; preferably *Prevotella* sp.P5-125 Cas13b.

Statement 99. The composition of any of Statements 89-98, wherein said guide molecule comprises a guide sequence is capable of hybridizing with a target RNA sequence comprising an Adenine to form an RNA duplex, wherein said guide sequence comprises a non-pairing Cytosine at a position corresponding to said Adenine resulting in an A-C mismatch in the RNA duplex formed.

Statement 100. The composition of Statement 99, wherein said Cas13 protein is a Cas13a protein and said Cas13a comprises one or more mutations the two HEPN domains, particularly at position R474 and R1046 of Cas13a protein originating from Leptotrichia *wadei* or amino acid positions corresponding thereto of a Cas13a ortholog, or wherein said Cas13 protein is a Cas13b protein and said Cas13b comprises a mutation in one or more of positions R116, H121, R1177, H1182, preferably R116A, H121A, R1177A, H1182A of Cas13b protein originating from Bergeyella zoohelcum ATCC 43767 or amino acid positions corresponding thereto of a Cas13b ortholog, or wherein said Cas13 protein is a Cas13b protein and said Cas13b comprises a mutation in one or more of positions R128, H133, R1053, H1058, preferably H133 and H1058, preferably H133A and H1058A, of a Cas13b protein originating from *Prevotella* sp. P5-125 or amino acid positions corresponding thereto of a Cas13b orthologs.

Statement 101. The composition of Statement 100, wherein said Cas13, preferably Cas13b, is truncated, preferably C-terminally truncated, preferably wherein said Cas13 is a truncated functional variant of the corresponding wild type Cas13, optionally wherein said truncated Cas13b is encoded by nt 1-984 of *Prevotella* sp.P5-125 Cas13b or the corresponding nt of a Cas13b orthologue or homologue.

Statement 102. The composition of any one of Statements 89-101, wherein said guide molecule comprises a guide sequence is capable of hybridizing with a target RNA sequence comprising a Cytidine to be edited to form an RNA duplex.

Statement 103. The composition of any one of Statements 89-102, wherein said guide sequence has a length of about 20-53 nt, preferably 25-53 nt, more preferably 29-53 nt or 40-50 nt capable of forming said RNA duplex with said target sequence, and/or wherein the distance between said non-pairing C and the 5' end of said guide sequence is 20-30 nucleotides.

Statement 104. The composition of any one of Statements 89-103, wherein the guide sequence comprises more than one mismatch corresponding to different adenosine sites in the target RNA sequence or wherein two guide molecules are used, each comprising a mismatch corresponding to a different adenosine sites in the target RNA sequence.

Statement 105. The composition of any one of Statements 89-104, wherein cytidine deaminase protein or catalytic domain thereof is fused to a N- or C-terminus of said oligonucleotide binding protein, optionally by a linker, preferably where said linker is (GGGGS)3-11 (SEQ ID NO: 198, 212, 213, 199, 214, 215, 200, 216, 217), GSG5, or LEP-GEKPYKCPECGKSFSQSGALTRHQRTHTR (SEQ ID NO:253), or wherein said linker is an XTEN, linker.

Statement 106. The composition of any one of Statements 89-105, wherein said cytidine deaminase protein or catalytic domain thereof is inserted into an internal loop of said dead Cas13 protein.

Statement 107. The composition of any one of Statements 89-106, wherein said cytidine deaminase protein or catalytic domain thereof is linked to an adaptor protein and said guide molecule or said dead Cas13 protein comprises an aptamer sequence capable of binding to said adaptor protein, preferably wherein said adaptor sequence is selected from MS2, PP7, QP, F2, GA, fr, JP501, M12, R17, BZ13, JP34, JP500, KU1, M11, MX1, TW18, VK, SP, FI, ID2, NL95, TW19, AP205, φCb5, φCb8r, φCbl2r, φCb23r, 7s and PRR1.

Statement 108. The composition of any one of Statements 89-107, wherein said targeting domain and optionally said cytidine deaminase or catalytic domain thereof comprise one or more heterologous nuclear export signal(s) (NES(s)) or nuclear localization signal(s) (NLS(s)), preferably an HIV Rev NES or MAPK NES, preferably C-terminal.

Statement 109. The composition of any one of Statements 89-108, wherein the Cas13 protein is truncated at a C terminus, an N terminus, or both.

Statement 110. The composition of Statement 109, wherein the Cas13 is truncated by at least 20, at least 40, at least 60, at least 80, at least 100, at least 120, at least 140, at least 160, at least 180, at least 200, at least 220, at least 240, at least 260, or at least 300 amino acids on the C terminus.

Statement 111. The composition of Statement 109, wherein the Cas13 is truncated by at least 20, at least 40, at least 60, at least 80, at least 100, at least 120, at least 140, at least 160, at least 180, at least 200, at least 220, at least 240, at least 260, or at least 300 amino acids on the N terminus.

Statement 112. The composition of Statement 109, wherein the truncated form of the Cas13 effector protein has been truncated at C-terminal Δ984-1090, C-terminal Δ1026-1090, C-terminal Δ1053-1090, C-terminal Δ934-1090, C-terminal Δ884-1090, C-terminal Δ834-1090, C-terminal Δ784-1090, or C-terminal Δ734-1090, wherein amino acid positions of the truncations correspond to amino acid positions of *Prevotella* sp. P5-125 Cas13b protein.

Statement 113. The composition of Statement 109, wherein the truncated form of the Cas13 effector protein has been truncated at C-terminal Δ795-1095, wherein amino acid positions of the truncation correspond to amino acid positions of *Riemerella anatipestifer* Cas13b protein.

Statement 114. The composition of Statement 109, wherein the truncated form of the Cas13 effector protein has been truncated at C-terminal Δ 875-1175, C-terminal Δ 895-1175, C-terminal Δ 915-1175, C-terminal Δ 935-1175, C-terminal Δ 955-1175, C-terminal Δ 975-1175, C-terminal Δ 995-1175, C-terminal Δ 1015-1175, C-terminal Δ 1035-1175, C-terminal Δ 1055-1175, C-terminal Δ 1075-1175, C-terminal Δ 1095-1175, C-terminal Δ 1115-1175, C-terminal Δ 1135-1175, C-terminal Δ 1155-1175, wherein amino acid positions correspond to amino acid positions of *Porphyromonas gulae* Cas13b protein.

Statement 115. The composition of Statement 109, wherein the truncated form of the Cas13 effector protein has been truncated at N-terminal Δl-125, N-terminal Δ 1-88, or N-terminal Δ 1-72, wherein amino acid positions of the truncations correspond to amino acid positions of *Prevotella* sp. P5-125 Cas13b protein.

Statement 116. The composition of any one of Statements 89-115, wherein the adenosine deaminase is modified to convert activity to a cytidine deaminase.

Statement 117. The composition of Statement 116, wherein the adenosine deaminase is modified by one or more mutations at one or more positions selected from E396, C451, V351, R455, T375, K376, S486, Q488, R510, K594, R348, G593, S397, H443, L444, Y445, F442, E438, T448, A353, V355, T339, P539, V525 and I520.

Statement 118. The composition of Statement 116 or 117, wherein the adenosine deaminase is mutated at one or more positions selected from E488, V351, S486, T375, S370, P462, and N597.

Statement 119. The composition of Statement 116, 117, or 118, wherein the adenosine deaminase comprises one or more mutations selected from E488Q, V351G, S486A, T375S, S370C, P462A, and N597I.

Statement 120. The composition of any one of Statements 89-119, wherein the adenosine deaminase protein or catalytic domain thereof is a human, cephalopod, or *Drosophila* adenosine deaminase protein or catalytic domain thereof.

Statement 121. The composition of any one of Statements 89-120, wherein said adenosine deaminase protein or catalytic domain thereof has been modified to comprise a mutation at glutamic acid488 of the hADAR2-D amino acid sequence, or a corresponding position in a homologous ADAR protein.

Statement 122. The composition of Statement 121, wherein said glutamic acid residue at position 488 or a corresponding position in a homologous ADAR protein is replaced by a glutamine residue (E488Q).

Statement 123. The composition of Statement 121 or 122, wherein said adenosine deaminase protein or catalytic domain thereof is a mutated hADAR2d comprising mutation E488Q or a mutated hADAR1d comprising mutation E1008Q.

Statement 124. The composition of any one of Statements 89-123, wherein the targeting domain is a catalytically inactive Cas13 protein, or a nucleotide sequence encoding said catalytically inactive Cas13 protein.

Statement 125. The composition of Statement 124, wherein the catalytically inactive Cas13 protein is catalytically inactive Cas13a, catalytically inactive Cas13b, or catalytically inactive Cas13c.

Statement 126. The composition of Statement 124 or 125, wherein the catalytically inactive Cas13 protein is obtained from a Cas13 nuclease derived from a bacterial species selected from the group consisting of the bacterial species listed in any of Tables 4, 5, or 6.

EXAMPLES

Example 1: T Cell Epitopes of SpCas9

NetMHCIIpan analysis of SpCas9 compared to DRB1_0101, DRB1*0301, DRB1*0401, DRB1*0701, DRB1*0801, DRB1*1101, DRB1*1301, DRB1*1501 using a sliding 15-amino acid window yielded 746 weak binders and 203 strong binders. The number of 9-mer cores is substantially smaller as each hit is encompassed by multiple overlapping windows. Overall, the MHC core sequences by MHC allele are as follows:

| SEQ | CORE | Affinity (nM) | % Rank | Sequence ID Number |
|---|---|---|---|---|
| DRB1_0101 | | | | |
| 880 | WRQLLNAKL | 14.05 | 1.40 | (SEQ ID NO: 223) |
| 950 | VITLKSKLV | 14.60 | 1.60 | (SEQ ID NO: 224) |
| DRB1_0301 | | | | |
| 296 | ILLSDILRV | 78.30 | 1.10 | (SEQ ID NO: 225) |
| 639 | LFDDKVMKQ | 94.58 | 1.50 | (SEQ ID NO: 226) |
| 692 | LIHDDSLTF | 63.23 | 0.80 | (SEQ ID NO: 227) |
| 959 | LVSDFRKDF | 112.97 | 2.00 | (SEQ ID NO: 228) |
| 1278 | ILADANLDK | 27.41 | 0.05 | (SEQ ID NO: 229) |

| SEQ | CORE | Affinity (nM) | % Rank | Sequence ID Number |
|---|---|---|---|---|
| DRB1_0401 | | | | |
| 287 | FLAAKNLSD | 34.77 | 0.15 | (SEQ ID NO: 230) |
| 1034 | FYSNIMNFF | 76.93 | 1.50 | (SEQ ID NO: 231) |
| 1043 | FKTEITLAN | 50.87 | 0.50 | (SEQ ID NO: 232) |
| 1232 | FKTEITLAN | 50.87 | 0.50 | (SEQ ID NO: 232) |
| DRB1_0701 | | | | |
| 437 | IEKILTFRI | 36.82 | 1.70 | (SEQ ID NO: 233) |
| 1033 | FFYSNIMNF | 28.27 | 1.00 | (SEQ ID NO: 234) |
| 1232 | YLASHYEKL | 38.68 | 1.90 | (SEQ ID NO: 235) |
| DRB1_0801 | | | | |
| 131 | IYHLRKKLV | 90.26 | 0.90 | (SEQ ID NO: 236) |
| 155 | LAHMIKFRG | 65.32 | 0.30 | (SEQ ID NO: 237) |
| 208 | ILSARLSKS | 70.58 | 0.40 | (SEQ ID NO: 238) |
| 330 | LKALVRQQL | 88.40 | 0.90 | (SEQ ID NO: 239) |
| 369 | YKFIKPILE | 82.70 | 0.70 | (SEQ ID NO: 240) |
| 437 | IEKILTFRI | 89.50 | 0.90 | (SEQ ID NO: 233) |
| 950 | VITLKSKLV | 103.73 | 1.40 | (SEQ ID NO: 224) |
| 1078 | FATVRKVLS | 67.47 | 0.40 | (SEQ ID NO: 241) |
| DRB1_1101 | | | | |
| 131 | IYHLRKKLV | 24.33 | 0.50 | (SEQ ID NO: 236) |
| 154 | LAHMIKFRG | 20.02 | 0.30 | (SEQ ID NO: 237) |
| 208 | ILSARLSKS | 26.32 | 0.60 | (SEQ ID NO: 238) |
| 330 | LTLLKALVR | 35.09 | 1.20 | (SEQ ID NO: 242) |
| 369 | FYKFIKPIL | 35.49 | 1.30 | (SEQ ID NO: 243) |
| 549 | LFKTNRKVT | 42.32 | 1.70 | (SEQ ID NO: 244) |
| 646 | MKQLKRRRY | 35.39 | 1.30 | (SEQ ID NO: 245) |
| 654 | WGRLSRKLI | 32.27 | 1.00 | (SEQ ID NO: 246) |
| 950 | VITLKSKLV | 42.98 | 1.80 | (SEQ ID NO: 224) |
| 1077 | FATVRKVLS | 24.49 | 0.50 | (SEQ ID NO: 241) |
| DRB1_1301 | | | | |
| 61 | LKRTARRRY | 22.39 | 0.80 | (SEQ ID NO: 247) |
| 131 | IYHLRKKLV | 30.75 | 1.80 | (SEQ ID NO: 236) |
| 154 | LAHMIKFRG | 25.42 | 1.10 | (SEQ ID NO: 237) |
| 207 | ILSARLSKS | 21.93 | 0.70 | (SEQ ID NO: 238) |
| 208 | ARLSKSRRL | 14.31 | 0.15 | (SEQ ID NO: 248) |
| 329 | LTLLKALVR | 20.57 | 0.60 | (SEQ ID NO: 242) |
| 437 | IEKILTFRI | 25.56 | 1.10 | (SEQ ID NO: 233) |
| 548 | LLFKTNRKV | 23.28 | 0.90 | (SEQ ID NO: 249) |
| 643 | MKQLKRRRY | 29.07 | 1.50 | (SEQ ID NO: 245) |
| 950 | VITLKSKLV | 25.15 | 1.10 | (SEQ ID NO: 224) |
| DRB_1501 | | | | |
| 151 | IYLALAHMI | 52.63 | 1.50 | (SEQ ID NO: 250) |
| 156 | MIKFRGHFL | 36.11 | 0.60 | (SEQ ID NO: 251) |
| 437 | IEKILTFRI | 19.88 | 0.05 | (SEQ ID NO: 233) |
| 950 | VITLKSKLV | 40.26 | 0.80 | (SEQ ID NO: 224) |
| 1034 | FFYSNIMNF | 52.50 | 1.50 | (SEQ ID NO: 234) |
| 1232 | FLYLASHYE | 48.77 | 1.30 | (SEQ ID NO: 252) |

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and

SEQUENCE LISTING (264 sequences)

SEQ ID NO: 1 - protein, 1363 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLS

SEQ ID NO: 2 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 3 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 4 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 5 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 6 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 7 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 8 - protein, 1080 aa, Neisseria cinerea
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 9 - protein, 1003 aa, Campylobacter lari
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 10 - protein, 1145 aa, Alicyclobacillus macrosporangiidus
MVAVKSIKVKLMLGHLPEIREGLWHLHEAVNLGVRYYTEWLALLRQGNLYRRGKDGAQECYMTAEQCRQELLVRLRDRQKRNGHTGDPGTDEELLGVARRLYELLVPQSVGKKGQAQMLASGFLSPLADPKSEGGKGTSKSGRKPAWMGMKEAGDSRWVEAKARYEANKAKDPTKQVIASLEMYGLRPLFDVFTETYKTIRWMPLGKHQGVRAWDRDMFQQSLERLMSWESWNERVGAEFARLVDRRDRFREKHFTGQEHLVALAQRLEQEMKEASPGFESKSSQAHRITKRALRGADGIIDDWLKLSEGEPVDRFDEILRKRQAQNPRRFGSHDLFLKLAEPVFQPLWREDPSFLSRWASYNEVLNKLEDAKQFATFTLPSPCSNPVWARFENAEGTNIFKYDFLFDHFGKGRHGVRFQRMIVMRDGVPTEVEGIVVPIAPSRQLDALAPNDAASPIDVFVGDPAAPGAFRGQFGGAKIQYRRSALVRKGRREEKAYLCGFRLPSQRRTGTPADDAGEVFLNLSLRVESQSEQAGRRNPPYAAVFHISDQTRRVIVRYGEIERYLAEHPDTGIPGSRGLTSGLRVMSVDLGLRTSAAISVFRVAHRDELTPDAHGRQPFFFPIHGMDHLVALHERSHLIRLPGETESKKVRSIREQRLDRLNRLRSQMASLRLLVRTGVLDEQKRDRNWERLQSSMERGGERMPSDWWDLFQAQVRYLAQHRDASGEAWGRMVQAAVRTLWRQLAKQVRDWRKEVRRNADKVKIRGIARDVPGGHSLAQLDYLERQYRFLRSWSAFSVQAGQVVRAERDSRFAVALREHIDNGKKDRLKKLADRILMEALGYVYVTDGRRAGQWQAVYPPCQLVLLEELSEYRFSNDRPPSENSQLMVWSHRGVLEELIHQAQVHDVLVGTIPAAFSSRFDARTGAPGIRCRRVPSIPLKDAPSIPIWLSHYLKQTERDAAALRPGELIPTGDGEFLVTPAGRGASGVRVVHADINAAHNLQRRLWENFDLSDIRVRCDRREGKDGTVVLIPRLTNQRVKERYSGVIFTSEDGVSFTVGDAKTRRRSSASQGEGDDLSDEEQELLAEADDARERSVVLFRDPSGFVNGGRWTAQRAFWGMVHNRIETLLAERFSVSGAAEKVRG

SEQ ID NO: 11 - protein, 1108 aa, Unknown
  Bacillus hisashii strain C4
MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 12 - protein, 1364 aa, Candidatus Lindowbacteria bacterium
MPRDDLDLLTNLNSTAKGIRERGKTKEGTDKKKSGRKSSWPMDKAAWETAKTSDSSAHFLEKLKQHPDLKDAFGNLSSGGSKKLEYYKKLAGSAPWKESQSVILEKAARWKEAKQEREEKEQDSSEHGSKAAYRRLFDAGCLPMPEFAKYIDENQIEFGDLKLSDCGAEWKRGMWNQAGQRVRSHMGWQRRREKENAVYSLRKELFEKGGAIRRKKSEELTPEDILPGKAAPDQNDWQERPAYGNQMWFIGLRSYEENEMAKYAEEAGMGSRSAPRIRRGTIKGWSKLRERWLQILKRNPQATRDDLIGELNALRSQDPRAYGDARLFDWLSKTDQRFLWDGFDADGKILCGRDDRDCVSAFVAYNEEFADEPSSITLTETDERLHPVWPFFGESSAVPYEIEYDLETACPTAIRLPLLVGKENGGYAERQGTRLPLAEYADLASSFQLPTPVRLDVLVEIREVTRAGRKVTCPFSYFKQNGVWYVREGEIPSGESIQIKQTDRKIENGKIFISSKLRMAYRDDLMVSPATGDFGSIKILWERIELASHVDQKKLPETAPARSRVFVSFSCNVVERAPRKQLTRKPDAVVVTIPSGVDQGLVVVSTDVRTGKSKSSSAPPLPPGSRLWPADAVHGDPPLRILSVDLGHRHSAYAVWELGLQQKSWRAGVLKGSTQTPVYADCTGTGLLCLPGDGEDTPAEEESLRLRSRQIRRRLNLQNSILRVSRLLSLDKFEKTIFEQSDVRDRPNKKGLRIRRRCRTEKTPLSEAEVRKNCDKAAEILIRWADTDAMAKSLAATGNADISFWKYMAVKNPPLSAVVDVAPSTIVPDDGPDRETLKKKRQEEEEKFASSIYENRVKLAGALCSGYDADHRRPATGGLWHDLDRTLIREISYGDRGQKGNPRKLNNEGILRLLRRPPRARPDWREFHRTLNDANRIPKGRTLRGGLSMGRLNFLKEVGDFVKKWSCRPRWPGDRRHIPPGQLFDRQDAEHLEHLRDDRIKRLAHLIVAQALGFEPDIRRGLWKYVDGSTGEILWQHPETRRFFAEGAAGELREVSRPAEIDDDAAARPHTVSAPAHIVVFENLIRYRFQSDRPKTENAGLMQWAHRQIVHFTKQVASLYGLKVAMVYAAFSSKFCSRCGSPGARVSRFDPAWRNQEWFKRRTSNPRSKVDHSLKRASEDPTADETRPWVLIEGGKEFVCANAKCSAHDEPLNADENAAANIGLRFLRGVEDFRTKVNPAGALKGKLRFETGIHSFRPPVSGSPFWSPMAEPAQKKKIGAAAPGADVDEAGDADESGVVVLFRDPSGAFRNKQYWYEGKIFWSNVMMAVEAKIAGASVGAKPVAASWGQAQPQSGPGLAKPGGD

SEQ ID NO: 13 - protein, 1364 aa, Elusimicrobia bacterium RIFOXYA12_FULL_57_11
MNRIYQGRVTKVEVPDGKDEKGNIKWKKLENWSDILWQHHMLFQDAVNYYTLALAAISGSAVGSDEKSIILREWAVQVQNIWEKAKKKATVFEGPQKRLTSILGLEQNASFDIAAKHILRTSEAKPEQRASALIRLLEEIDKKNHNVVCGERLPFFCPRNIQSKRSPTSKAVSSVQEQKRQEEVRRFHNMQPEEVVKNAVTLDISLFKSSPKIVFLEDPKKARAELLKQFDNACKKHKELVGIKKAFTESIDKHGSSLKVPAPGSKPSGLYPSAIVFKYFPVDITKTVFLKATEKLAMGKDREVTNDPIADARVNDKPHFDYFTNIALIREKEKNRAAWFEFDLAAFIEAIMSPHRFYQDTQKRKEAARKLEEKIKAIEGKGGQFKESDSEDDDVDSLPGFEGDTRIDLLRKLVTDTLGWLGESETPDNNEGKKTEYSISERTLRIFPDIQKQWSELAEKGETTEGKLLEVLKHEQTEHQSDFGSATLYQHLAKPEFHPIWLKSGTEEWHAENPLKAWLNYKELQYELTDKKRPIHFTPAHPVYSPRYFDFPKKSETEEKEVSKNTHSLTTSLASEHIKNSLQFTAGLIRKTNVGKKAIKARFSYSAPRLRRDCLRSENNENLYKAPWLQPMMRALGIDEEKADRQNFANTRITLMAKGLDDIQLGFPVEANSQELQKEVSNGISWKGQFNWGGIASLSALRWPHEKKPKNPPEQPWWGIDSFSCLAVDLGQRYAGAFARLDVSTIEKKGKSRFIGEACDKKWYAKVSRMGLLRLPGEDVKVWRDASKIDKENGFAFRKELFGEKGRSATPLEAEETAELIKLFGANEKDVMPDNWSKELSFPEQNDKLLIVARRAQAAVSRLHRWAWFFDEAKRSDDAIREILESDDTDLKQKVNKNEIEKVKETIISLLKVKQELLPTLLTRLANRVLPLRGRSWEWKKHHQKNDGFILDQTGKAMPNVLIRGQRGLSMDRIEQITELRKRFQALNQSLRRQIGKKAPAKRDDSIPDCCPDLLEKLDHMKEQRVNQTAHMILAEALGLKLAEPPKDKKELNETCDMHGAYAKVDNPVSFIVIEDLSRYRSSQGRSPRENSRLMKWCHRAVRDKLKEMCEVFFPLCERRKAGSAWVSLPPLLETPAAYSSRFCSRSGVAGFRAVEVIPGFELKYPWSWLKDKKDKAGNLAKEALNIRTVSEQLKAFNQDKPEKPRTLLVPIAGGPIFVPISEVGLSSFGLKPQVVQADINAAINLGLRAISDPRIWEIHPRLRTEKRDGRLFAREKRKYGEEKVEVQPSKNEKAKKVKDDRKPNYFADFSGKVDWGFGNIKNESGLTLVSGKALWWTINQLQWERCFDINKRHIEDWSNKQKQ

SEQ ID NO: 14 - protein, 1413 aa, Omnitrophica WOR_2 bacterium sp.
MNRIYQGRVTKVEKLKNGKSPDDREELKDWQTALWRHHELFQDAVSYYTLALAAMAEGLPDKHPINVLRKRMEEAWEEFPRKTVTPAKNLRDSVRPWLGLSESASFGDALKKILPPAPENKEVRALAVALLAEKARTLKPQKTSASYWGRFCDDLKKKPNWDYSEEELARKTGSGDWVAGLWSEDALNKIDELAKSLKLSSLVKCVPDGQINPEGARNLVKEALDHLEGVSNGTKKEKNDPGPAKKTNNWLRQHASDVRNFIHKNKNQFSSLPNGRLITERARGGGININKTYAGVLFKAFPCPFTFDYVRAAVPEPKVKKVDQEKKSEQSATWTELEKRILRIGDDPIELARKNNKPIFKAFTALEKWSDQNSKSCWSDFDKCAFEEALKTLNQFNQKTEEREKRRSEAEAELKYMMDENPEWKPKKETEGDDVREVPILKGDPRYEKLVKLFGDLDEEGSEHATGKIYGPSRASLRGFGKLRNEWVDLFTKANDNPREQDLQKAVTGFQREHKLDMGYTAFFLKLCERDYWDIWRDDTEVEVKKIREKRWVKSVVYAAADTRELAEELERLQEPVRYTPAEPQFSRRLFMFSDIKGKQGAKHIREGLVEVSLAVKDQSGKYGTCRVRLHYSAPRLIRDHLSDGSSSMWLQPMMAALGLSSDARGCFTRDSKGNVKEPAVALMSDFVGRKRELRMLLNFPVDLDISKLEENIGKKARWEKQMNTAYEKNKLKQRFHLIWPGMELKETQEPGQFWWDNPTIQKEGMYCLAIDLSQRRAADYALLHAGVNRDSKTFVELGQAGGQSWFTKLCAAGSLRLPGEDTEVIREGKRQIELSGKKGRNATQSEYDQAIALAKQLLHNENSAELESAARDWLGDNAKRFSFPEQNDKLIDLYYGALSRYKTWLRWSWRLTEQHKELWDKTLDEIRKVPYFASWGELAGNGTNEATVQQLQKLIADAAVDLRNFLEKALLHIAYRALPLRENTWRWIENGKDGKGKPLHLLVSDGQSPAEIPWLRGQRGLSIARIEQLENFRRAVLSLNRLLRHEIGTKPEFGSSTCGESLPDPCPDLTDKIVRLKEERVNQTAHLIIAQSLGVRLKGHSLFTEEREKADMHGEHEVIPGRSPVDFVVLEDLSRYTTDKSRSRSENSRLMKWCHRKINEKVKLLAEPFGIPVIEVFASYSSKFDARTGAPGFRAVEVTSEDRPFWRKTIEKQSVAREVFDCLDNLVGKGLNGIHLVLPQNGGPLFIAAVKEDQPLPAIRQADINAAVNIGLRAIAGPSCYHAHPKVRLIKGESGTDKGKWLPRKGKEANKRENAQFGNVDLDLEVKFNRLDIDSDVLKGDNTNLFHDPLNIACYGFATIQNLQHPFLAHASAVFSRQKGAVARLQWEVCRAINSRRLEAWQKKAEKAAVKR

SEQ ID NO: 15 - protein, 747 aa, Phycisphaerae bacterium ST-NAGAB-D1
MATKSYRARILTDSRLAAALDRTHVVFVESLKQMINTYLRMQNGKFGPDHKKLAQIMLSRSNTFAHGVMDQITRDQPTSTLDEEWTDLARRIHKTTGPLFLQAERFATVKNRAIHTKSRGKVIPSPETLAVPAKFWHQVCDSASAYIRSNRELMQQWRKDRAAWLKDKNEWQQKHPEFMQFYNGPYQNFLKLCDDDRITSQLAAEQQPTASKNNRPRKTGKRFARWHLWYKWLSENPEIIEWRNKASASDFKTVTDDVRKQIITKYPQQNKYITRLLDWLEDNNPELKTLENLRRTYVKKFDSFKRPPTLTLPSPYRHPYWFTMELDQFYKKADFENGTIQLLLIDEDDDGNWFFNWMPASLKPDPRLVPSWRAETFETEGRFPPYLGGKIGKKLSRPAPTDAERKAGIAGAKLMIKNNRSELLFTVFEQDCPPRVKWAKTKNRKCPADNAFSSDGKTRKPLRILSIDLGIRHIGAFALTQGTRNDSAWQTESLKKGIINSPSIPPLRQVRRHDYDLKRKRRRHGKPVKGQRSNANLQAHRTNMAQDRFKKGASAIVSLAREHSADLILFENLHSLKFSAFDERWMNRQLRDMNRRHIVELVSEQAPEFGITVKDDINPWMTSRICSNCNLPGFRFSMKKKNPYREKLPREKCTDFGYPVWEPGGHLFRCPHCDHRVNADINAAANLANKFFGLGYWNNGLKYDAETKTFTVHTDKKTPPLIFKPRPQFDLWADSVKTRKQLGPDPF

SEQ ID NO: 16 - protein, 743 aa, Planctomycetes bacterium RBG_13_46_10
MSVRSFQARVECDKQTMEHLWRTHKVFNERLPEIIKILFKMKRGECGQNDKQKSLYKSISQSILEANAQNADYLLNSVSIKGWKPGTAKKYRNASFTWADDAAKLSSQGIHVYDKKQVLGDLPGMMSQMVCRQSVEAISGHIELTKKWEKEHNEWLKEKEKWESEDEHKKYLDLREKFEQFEQSIGGKITKRRGRWHLYLKWLSDNPDFAAWRGNKAVINPLSEKAQIRINKAKPNKKNSVERDEFFKANPEMKALDNLHGYYERNFVRRRKTKKNPDGFDHKPTFTLPHPTIHPRWFVFNKPKTNPEGYRKLILPKKAGDLGSLEMRLLTGEKNKGNYPDDWISVKFKADPRLSLIRPVKGRRVVRKGKEQGQTKETDSYEFFDKHLKKWRPAKLSGVKLIFPDKTPKAAYLYFTCDIPDEPLTETAKKIQWLETGDVTKKGKKRKKKVLPHGLVSCAVDLSMRRGTTGFATLCRYENGKIHILRSRNLWVGYKEGKGCHPYRWTEGPDLGHIAKHKREIRILRSKRGKPVKGEESHIDLQKHIDYMGEDRFKKAARTIVNFALNTENAASKNGFYPRADVLLLENLEGLIPDAEKERGINRALAGWNRRHLVERVIEMAKDAGFKRRVFEIPPYGTSQVCSKCGALGRRYSIIRENNRREIRFGYVEKLFACPNCGYCANADHNASVNLNRRFLIEDSFKSYYDWKRLSEKKQKEEIETIESKLMDKLCAMHKISRGSISK

SEQ ID NO: 17 - protein, 1119 aa, Spirochaetes bacterium GWB1_27_13
MSFTISYPFKLIIKNKDEAKALLDTHQYMNEGVKYYLEKLLMFRQEKIFIGEDETGKRIYIEETEYKKQIEEFYLIKKTELGRNLTLTLDEFKTLMRELYICLVSSSMENKKGFPNAQQASLNIFSPLFDAESKGYILKEENNNISLIHKDYGKILLKRLRDNNLIPIFTKFTDIKKITAKLSPTALDRMIFAQAIEKLLSYESWCKLMIKERFDKEVKIKELENKCENKQERDKIFEILEKYEEERQKTFEQDSGFAKKGKFYITGRMLKGFDEIKEKWLKEKDRSEQNLINILNKYQTDNSKLVGDRNLFEFIIKLENQCLWNGDIDYLKIKRDINKNQIWLDRPEMPRFTMPDFKKHPLWYRYEDPSNSNFRNYKIEVVKDENYITIPLITERNNEYFEENYTFNLAKLKKLSENITFIPKSKNKEFEFIDSNDEEEDKKDQKKSKQYIKYCDTAKNTSYGKSGGIRLYFNRNELENYKDGKKMDSYTVFTLSIRDYKSLFAKEKLQPQIFNTVDNKITSLKIQKKFGNEEQTNFLSYFTQNQITKKDWMDEKTFQNVKELNEGIRVLSVDLGQRFFAAVSCFEIMSEIDNNKLFFNLNDQNHKIIRINDKNYYAKHIYSKTIKLSGEDDDLYKERKINKNYKLSYQERKNKIGIFTRQINKLNQLLKIIRNDEIDKEKFKELIETTKRYVKNTYNDGIIDWNNVDNKILSYENKEDVINLHKELDKKLEIDFKEFIRECRKPIFRSGGLSMQRIDFLEKLNKLKRKWVARTQKSAESIVLTPKFGYKLKEHINELKDNRVKQGVNYILMTALGYIKDNEIKNDSKKKQKEDWVKKNRACQIILMEKLTEYTFAEDRPREENSKLRMWSHRQIFNFLQQKASLWGILVGDVFAPYTSKCLSDNNAPGIRCHQVTKKDLIDNSWFLKIVVKDDAFCDLIEINKENVKNKSIKINDILPLRGGELFASIKDGKLHIVQADINASRNIAKRFLSQINPFRVVLKKDKDETFHLKNEPNYLKNYYSILNFVPTNEELTFFKVEENKDIKPTKRIKMDKHEKESTDEGDDYSKNQIALFRDDSGIFFDKSLWVDGKIFWSVVKNKMTKLLRERNNKKNGSK

SEQ ID NO: 18 - protein, 1447 aa, Verrucomicrobiaceae bacterium UBA2429
MPLSRIYQGRTNSLIILTPTPQEPWDHKALARFDSPLWRHHALFQDAVNYYQLCLVALASSDGTRPLSKLHEQMKASWDEAKTDTEDSWRVRLARRLGIPAASLFEAALAKVLEGNEAPERARELAGELLLDKIEGDIQQAGRGYWPRFCDPKANPTYDYSATARASASGLTKLAAVIHAENVTEEALKQVAAEMDLSWTVKLQPDKNFVGAEARARLLEAAHHFIKVAESPPTKLAEVLARFPDGLALWQALPEKIAALPEETQVPRNRKASPDLTFATLLFQHFPSLFTAAVLGLSVGKPKSVKAPKVVEKVSARRKANAVTQAVVIEEPEIDFAELGDDPIKLARGERGFVFPAFTSLSFWAVPGPHVPVWKEFDIAAFKEALKTVNQFKLKTSERNALLAEAQRRLDYMDEKTHDWKTGDSDEPGHIPPRLKSDPNFTLIQALTQDEGVSNKATGDQHIPKGVYTGGLRGFYAIKKDWCELWERKADKSQGTPTEEELISIVTDYQRDHVYDVGDVGLFRALCEPRFWPLWQPLTDEQEAERIKAGRAKDMISAYRVWLELQEDVVRLAQPIRFTPAHAENSRRLFMFSDISGSHGAEFGSDGKSLEVSIAYDVDGKLQPVRAKLEFSAPRAARDELEGLSGGSESMRWFQPMMKALDCPEVEMPALEKCAVSLMPDVVKKGGGKWVRLLLNFPATLEPEGLIRHIGKQAMWYKQFNGTYKPRTQQLDTGLHLYWPGLEKAPEAEDAAAWWNREEIRAKGFSVLSVDLGQRDAGAWALLESRSDKAFSRNRQPFIELGEAGGKLWSTALLGLGMLRLPGEDARTGALDDQGKRAVEFHGKAGRNALEAEWQEAREMALLFGGEEAKSRLGPGFDHLSHSKQNEELLRILSRAQSRLARFHRWSCRIHEKPEATGDDVIDYGQVDELLTKTAEAMLENLKALYTNAGGILDSKSKQPLTLVGLRKKLEAQKVEPEKIAAVLKPHAEIIFQRLGTLIPELKQHLRVSLERLANRELPLRHREWVWNEAFEKLEQGNFKKEENPKWIRGQRGLSMARIEQIENLRKRFMSLRRQMSLIPGEQVKQGVEDKGQRQPEPCEDILNKLDRMKQQRVNQTAHLILAQALGLRLRPHLANDAEREEKDIHGEYELIPGRKPVDFIVMEDLSRYLSSQGRAPSENGRLMKWCHRAVLAKLKQMCEPFGIPVLEVPAAYSSRFCALTGVPGFRAVEVHDGNAEDFRWKRLIKKAEKDKSSKDAEAAAMLFDQLHDLNIEAREARKQDKKLPLRTLFAPVAGGPLFIPMVGGGPRQADMNAAINLGLRAIASPTCLRARPKIRAELKDGKHQAMLGNKLEKAAALTLEPPKEPTKELAAQKRTNFFLDEKFVGKFDTAHVTTSGKKLRLSGGMSLWKAIKDGAWQRVKKINDARIAKWKNNPPPEPDPDDEIQF

SEQ ID NO: 19 - protein, 1147 aa, Alicyclobacillus kakegawensis
MAVKSIKVKLRLSECPDILAGMWQLHRATNAGVRYYTEWVSLMRQEILYSRGPDGGQQCYMTAEDCQRELLRRLRNRQLHNGRQDQPGTDADLLAISRRLYEILVLQSIGKRGDAQQIASSFLSPLVDPNSKGGRGEAKSGRKPAWQKMRDQGDPRWVAAREKYEQRKAVDPSKEILNSLDALGLRPLFAVFTETYRSGVDWKPLGKSQGVRTWDRDMFQQALERLMSWESWNRRVGEEYARLFQQKMKFEQEHFAEQSHLVKLARALEADMRAASQGFEAKRGTAHQITRRALRGADRVFEIWKSIPEEALFSQYDEVIRQVQAEKRRDFGSHDLFAKLAEPKYQPLWRADETFLTRYALYNGVLRDLEKARQFATFTLPDACVNPIWTRFESSQGSNLHKYEFLFDHLGPGRHAVRFQRLLVVESEGAKERDSVVVPVAPSGQLDKLVLREEEKSSVALHLHDTARPDGFMAEWAGAKLQYERSTLARKARRDKQGMRSWRRQPSMLMSAAQMLEDAKQAGDVYLNISVRVKSPSEVRGQRRPPYAALFRIDDKQRRVTVNYNKLSAYLEEHPDKQIPGAPGLLSGLRVMSVDLGLRTSASISVFRVAKKEEVEALGDGRPPHYYPIHGTDDLVAVHERSHLIQMPGETETKQLRKLREERQAVLRPLFAQLALLRLLVRCGAADERIRTRSWQRLTKQGREFTKRLTPSWREALELELTRLEAYCGRVPDDEWSRIVDRTVIALWRRMGKQVRDWRKQVKSGAKVKVKGYQLDVVGGNSLAQIDYLEQQYKFLRRWSFFARASGLVVRADRESHFAVALRQHIENAKRDRLKKLADRILMEALGYVYEASGPREGQWTAQHPPCQLIILEELSAYRFSDDRPPSENSKLMAWGHRGILEELVNQAQVHDVLVGTVYAAFSSRFDARTGAPGVRCRRVPARFVGATVDDSLPLWLTEFLDKHRLDKNLLRPDDVIPTGEGEFLVSPCGEEAARVRQVHADINAAQNLQRRLWQNFDITELRLRCDVKMGGEGTVLVPRVNNARAKQLFGKKVLVSQDGVTFFERSQTGGKPHSEKQTDLTDKELELIAEADEARAKSVVLFRDPSGHIGKGHWIRQREFWSLVKQRIESHTAERIRVRGVGSSLD

SEQ ID NO: 20 - protein, 1112 aa, Bacillus sp. V3-13
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 21 - protein, 1489 aa, Desulfatirhabdium butyrativorans
MPLSNNPPVTQRAYTLRLRGADPSDLSWREALWHTHEAVNKGAKVFGDWLLTLRGGLDHTLADTKVKGGKGKPDRDPTPEERKARRILLALSWLSVESKLGAPSSYIVASGDEPAKDRNDNVVSALEEILQSRKVAKSEIDDWKRDCSASLSAAIRDDAVWVNRSKVFDEAVKSVGSSLTREEAWDMLERFFGSRDAYLTPMKDPEDKSSETEQEDKAKDLVQKAGQWLSSRYGTSEGADFCRMSDIYGKIAAWADNASQGGSSTVDDLVSELRQHFDTKESKATNGLDWIIGLSSYTGHTPNPVHELLRQNTSLNKSHLDDLKKKANTRAESCKSKIGSKGQRPYSDAILNDVESVCGFTYRVDKDGQPVSVADYSKYDVDYKWGTARHYIFAVMLDHAARRISLAHKWIKRAEAERHKFEEDAKRIANVPARAREWLDSFCKERSVTSGAVEPYRIRRRAVDGWKEVVAAWSKSDCKSTEDRIAAARALQDDSEIDKFGDIQLFEALAEDDALCVWHKDGEATNEPDFQPLIDYSLAIEAEFKKRQFKVPAYRHPDELLHPVFCDFGKSRWKINYDVHKNVQAPFYRGLCLTLWTGSEIKPVPLCWQSKRLTRDLALGNNHRNDAASAVTRADRLGRAASNVTKSDMVNITGLFEQADWNGRLQAPRQQLEAIAVVRDNPRLSEQERNLRMCGMIEHIRWLVTFSVKLQPQGPWCAYAEQHGLNTNPQYWPHADTNRDRKVHARLILPRLPGLRVLSVDLGHRYAAACAVWEAVNTETVKEACQNVGRDMPKEHDLYLHIKVKKQGIGKQTEVDKTTIYRRIGADTLPDGRPHPAPWARLDRQFLIKLQGEEKDAREASNEEIWALHQMECKLDRTKPLIDRLIASGWGLLKRQMARLDALKELGWIPAPDSSENLSREDGEAKDYRESLAVDDLMFSAVRTLRLALQRHGNRARIAYYLISEVKIRPGGIQEKLDENGRIDLLQDALALWHELFSSPGWRDEAAKQLWDSRIATLAGYKAPEENGDNVSDVAYRKKQQVYREQLRNVAKTLSGDVITCKELSDAWKERWEDEDQRWKKLLRWFKDWVLPSGTQANNATIRNVGGLSLSRLATITEFRRKVQVGFFTRLRPDGTRHEIGEQFGQKTLDALELLREQRVKQLASRIAEAALGIGSEGGKGWDGGKRPRQRINDSRFAPCHAVVIENLANYRPDETRTRLENRRLMTWSASKVHKYLSEACQLNGLYLCTVSAWYTSRQDSRTGAPGIRCQDVSVREFMQSPFWRKQVKQAEAKHDENKGDARERFLCELNKTWKAKTPAEWKKAGFVRIPLRGGEIFVSADSKSPSAKGIHADLNAAANIGLRALTDPDWPGKWWYVPCDPVSFESKMDYVKGCAAVKVGQPLRQPAQTNADGAASKIRKGKKNRTAGTSKEKVYLWRDISAFPLESNEIGEWKETSAYQNDVQYRVIRMLKEHIKSLDNRTGDNVEG

SEQ ID NO: 22 - protein, 1194 aa, Desulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 23 - protein, 1326 aa, Lentisphaeria bacterium
MAVELNRIYQGRVNHVYIFDENQNQVSVDNGDDLLFVHHELYQDAINYYLVALAAMALDSKDSLFGKFKMQIRAVWNDFYRNGQLRPGLKHSLIRSLGHAAELNTSNGADIAMNLILEDGGIPSEILNAALEHLAEKCTGDVSQLGKTFFPRFCDTAYHGNWDVDAKSFSEKKGRQRLVDALYSLHPVQAVQELAPEIEIGWGGVKTQTGKFFTGDEAKASLKKAISYFLQDTGKNSPELQEYFSVAGKQPLEQYLGKIDTFPEISFGRISSHQNINISNAMWILKFFPDQYSVDLIKNLIPNKKYEIGIAPQWGDDPVKLSRGKRGYTFRAFTDLAMWEKNWKVFDRAAFSDALKTINQFRNKTQERNDQLKRYCAALNWMDGESSDKKPPVEPADADAVDEAATSVLPILAGDKRWNALLQLQKELGICNDFTENELMDYGLSLRTIRGYQKLRSMMLEKEEKMRAKTADDEEISQALQEIIIKFQSSHRDTIGSVSLFLKLAEPKYFCVWHDADKNQNFASVDMVADAVRYYSYQEEKARLEEPIQITPADARYSRRVSDLYALVYKNAKECKTGYGLRPDGNFVFEIAQKNAKGYAPAKVVLAFSAPRLKRDGLIDKEFSAYYPPVLQAFLREEEAPKQSFKTTAVILMPDWDKNGKRRILLNFPIKLDVSAIHQKTDHRFENQFYFANNTNTCLLWPSYQYKKPVTWYQGKKPFDVVAVDLGQRSAGAVSRITVSTEKREHSVAIGEAGGTQWYAYRKFSGLLRLPGEDATVIRDGQRTEELSGNAGRLSTEEETVQACVLCKMLIGDATLLGGSDEKTIRSFPKQNDKLLIAFRRATGRMKQLQRWLWMLNENGLCDKAKTEISNSDWLVNKNIDNVLKEEKQHREMLPAILLQIADRVLPLRGRKWDWVLNPQSNSFVLQQTAHGSGDPHKKICGQRGLSFARIEQLESLRMRCQALNRILMRKTGEKPATLAEMRNNPIPDCCPDILMRLDAMKEQRINQTANLILAQALGLRHCLHSESATKRKENGMHGEYEKIPGVEPAAFVVLEDLSRYRFSQDRSSYENSRLMKWSHRKILEKLALLCEVFNVPILQVGAAYSSKFSANAIPGFRAEECSIDQLSFYPWRELKDSREKALVEQIRKIGHRLLTFDAKATIIMPRNGGPVFIPFVPSDSKDTLIQADINASFNIGLRGVADATNLLCNNRVSCDRKKDCWQVKRSSNFSKMVYPEKLSLSFDPIKKQEGAGGNFFVLGCSERILTGTSEKSPVFTSSEMAKKYPNLMFGSALWRNEILKLERCCKINQSRLDKFIAKKEVQNEL

SEQ ID NO: 24 - protein, 1090 aa, Laceyella sediminis
MSIRSFKLKIKTKSGVNAEELRRGLWRTHQLINDGIAYYMNWLVLLRQEDLFIRNEETNEIEKRSKEEIQGELLERVHKQQQRNQWSGEVDDQTLLQTLRHLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTELFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSYERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVQRMEE

SEQ ID NO: 25 - protein, 1041 aa, Methylobacterium nodulans
MYEAIVLADDANAQLANAFLGPLTDPNSAGFLEAFNKVDRPAPSWLDQVPASDPIDPAVLAEANAWLDTDAGRAWLVDTGAPPRWRSLAAKQDPIWPREFARKLGELRKEAASGTSAIIKALKRDFGVLPLFQPSLAPRILGSRSSLTPWDRLAFRLAVGHLLSWESWCTRARDEHTARVQRLEQFSSAHLKGDLATKVSTLREYERARKEQIAQLGLPMGERDFLITVRMTRGWDDLREKWRRSGDKGQEALHAIIATEQTRKRGRFGDPDLFRWLARPENHHVWADGHADAVGVLARVNAMERLVERSRDTALMTLPDPVAHPRSAQWEAEGGSNLRNYQLEAVGGELQITLPLLKAADDGRCIDTPLSFSLAPSDQLQGVVLTKQDKQQKITYCTNMNEVFEAKLGSADLLLNWDHLRGRIRDRVDAGDIGSAFLKLALDVAHVLPDGVDDQLARAAFHFQSAKGAKSKHADSVQAGLRVLSIDLGVRSFATCSVFELKDTAPTTGVAFPLAEFRLWAVHERSFTLELPGENVGAAGQQWRAQADAELRQLRGGLNRHRQLLRAATVQKGERDAYLTDLREAWSAKELWPFEASLLSELERCSTVADPLWQDTCKRAARLYRTEFGAVVSEWRSRTRSREDRKYAGKSMWSVQHLTDVRRFLQSWSLAGRASGDIRRLDRERGGVFAKDLLDHIDALKDDRLKTGADLIVQAARGFQRNEFGYWVQKHAPCHVILFEDLSRYRMRTDRPRRENSQLMQWAHRGVPDMVGMQGEIYGIQDRRDPDSARKHARQPLAAFCLDTPAAFSSRYHASTMTPGIRCHPLRKREFEDQGFLELLKRENEGLDLNGYKPGDLVPLPGGEVFVCLNANGLSRIHADINAAQNLQRRFWTQHGDAFRLPCGKSAVQGQIRWAPLSMGKRQAGALGGFGYLEPTGHDSGSCQWRKTTEAEWRRLSGAQKDRDEAAAAEDEELQGLEEELLERSGERVVFFRDPSGVVLPTDLWFPSAAFWSIVRAKTVGRLRSHLDAQAEASYAVAAGL

SEQ ID NO: 26 - protein, 1388 aa, Opitutaceae bacterium
MSLNRIYQGRVAAVETGTALAKGNVEWMPAAGGDEVLWQHHELFQAAINYYLVALLALADKNNPVLGPLISQMDNPQSPYHVWGSFRRQGRQRTGLSQAVAPYITPGNNAPTLDEVFRSILAGNPTDRATLDAALMQLLKACDGAGAIQQEGRSYWPKFCDPDSTANFAGDPAMLRREQHRLLLPQVLHDPAITHDSPALGSFDTYSIATPDTRTPQLTGPKARARLEQAITLWRVRLPESAADFDRLASSLKKIPDDDSRLNLQGYVGSSAKGEVQARLFALLLFRHLERSSFTLGLLRSATPPPKNAETPPPAGVPLPAASAADPVRIARGKRSFVFRAFTSLPCWHGGDNIHPTWKSFDIAAFKYALTVINQIEEKTKERQKECAELETDFDYMHGRLAKIPVKYTTGEAEPPPILANDLRIPLLRELLQNIKVDTALTDGEAVSYGLQRRTIRGFRELRRIWRGHAPAGTVFSSELKEKLAGELRQFQTDNSTTIGSVQLFNELIQNPKYWPIWQAPDVETARQWADAGFADDPLAALVQEAELQEDIDALKAPVKLTPADPEYSRRQYDFNAVSKFGAGSRSANRHEPGQTERGHNTFTTEIAARNAADGNRWRATHVRIHYSAPRLLRDGLRRPDTDGNEALEAVPWLQPMMEALAPLPTLPQDLTGMPVFLMPDVTLSGERRILLNLPVTLEPAALVEQLGNAGRWQNQFFGSREDPFALRWPADGAVKTAKGKTHIPWHQDRDHFTVLGVDLGTRDAGALALLNVTAQKPAKPVHRIIGEADGRTWYASLADARMIRLPGEDARLFVRGKLVQEPYGERGRNASLLEWEDARNIILRLGQNPDELLGADPRRHSYPEINDKLLVALRRAQARLARLQNRSWRLRDLAESDKALDEIHAERAGEKPSPLPPLARDDAIKSTDEALLSQRDIIRRSFVQIANLILPLRGRRWEWRPHVEVPDCHILAQSDPGTDDTKRLVAGQRGISHERIEQIEELRRRCQSLNRALRHKPGERPVLGRPAKGEEIADPCPALLEKINRLRDQRVDQTAHAILAAALGVRLRAPSKDRAERRHRDIHGEYERFRAPADFVVIENLSRYLSSQDRARSENTRLMQWCHRQIVQKLRQLCETYGIPVLAVPAAYSSRFSSRDGSAGFRAVHLTPDHRHRMPWSRILARLKAHEEDGKRLEKTVLDEARAVRGLFDRLDRFNAGHVPGKPWRTLLAPLPGGPVFVPLGDATPMQADLNAAINIALRGIAAPDRHDIHHRLRAENKKRILSLRLGTQREKARWPGGAPAVTLSTPNNGASPEDSDALPERVSNLFVDIAGVANFERVTIEGVSQKFATGRGLWASVKQRAWNRVARLNETVTDNNRNEEEDDIPM

SEQ ID NO: 27 - protein, 1345 aa, Francisella tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNKRPAATKKAGQAKKKKGSYPYDVPDYAYPYDVPDYAYPYDVPDYA

SEQ ID NO: 28 - protein, 1278 aa, Lachnospiraceae bacterium MC2017
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKLLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLINKRPAATKKAGQAKKKKGSYPYDVPDYAYPYDVPDYAYPYDVPDYA

SEQ ID NO: 29 - protein, 1286 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEKARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAVKRPAATKKAGQAKKKKGSYPYDVPDYAYPYDVPDYAYPYDVPDYA

SEQ ID NO: 30 - protein, 1522 aa, Candidatus Peregrinibacteria bacterium sp.
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEDKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAIMKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTEIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDCWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKKAGQAKKKKGSYPYDVPDYAYPYDVPDYAYPYDVPDYA

SEQ ID NO: 31 - protein, 1397 aa, Parcubacteria group bacterium GWC2011_GWC2_44_17
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITFSKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKEKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDHKRPAATKKAGQAKKKKGSYPYDVPDYAYPYDVPDYAYPYDVPDYA

SEQ ID NO: 32 - protein, 1295 aa, Smithella sp. SC_K08D17
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYAWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKGKRPAATKKAGQAKKKKGSYPYDVPDYAYPYDVPDYAYPYDVPDYA

SEQ ID NO: 33 - protein, 1352 aa, Acidaminococcus sp. BV3L6
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKGSYPYDVPDYAYPYDVPDYAYPYDVPDYA

SEQ ID NO: 34 - protein, 1251 aa, Lachnospiraceae bacterium MA2020
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLLKRPAATKKAGQAKKKKGSYPYDVPDYAYPYDVPDYAYPYDVPDYA

SEQ ID NO: 35 - protein, 1283 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGDKRPAATKKAGQAKKKKGSYPYDVPDYAYPYDVPDYAYPYDVPDYA

SEQ ID NO: 36 - protein, 1327 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYEKRPAATKKAGQAKKKKGSYPYDVPDYAYPYDVPDYAYPYDVPDYA

SEQ ID NO: 37 - protein, 1418 aa, Moraxella bovoculi
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNRKRPAATKKAGQAKKKKGSYPYDVPDYAYPYDVPDYAYPYDVPDYA

SEQ ID NO: 38 - protein, 1308 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNRKRPAATKKAGQAKKKKGSYPYDVPDYAYPYDVPDYAYPYDVPDYA

SEQ ID NO: 39 - protein, 1273 aa, Lachnospiraceae bacterium ND2006
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHKRPAATKKAGQAKKKKGSYPYDVPDYAYPYDVPDYAYPYDVPDYA

SEQ ID NO: 40 - protein, 1305 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKDKRPAATKKAGQAKKKKGSYPYDVPDYAYPYDVPDYAYPYDVPDYA

SEQ ID NO: 41 - protein, 1368 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLKKRPAATKKAGQAKKKKGSYPYDVPDYAYPYDVPDYAYPYDVPDYA

SEQ ID NO: 42 - protein, 1291 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVEKRPAATKKAGQAKKKKGSYPYDVPDYAYPYDVPDYAYPYDVPDYA

SEQ ID NO: 43 - protein, 1343 aa, Thiomicrospira sp. XS5
MTKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQEKRPAATKKAGQAKKKKGSYPYDVPDYAYPYDVPDYAYPYDVPDYA

SEQ ID NO: 44 - protein, 1296 aa, Moraxella bovoculi
MLFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNRKRPAATKKAGQAKKKKGSYPYDVPDYAYPYDVPDYAYPYDVPDYA

SEQ ID NO: 45 - protein, 1306 aa, Moraxella bovoculi
MLFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPKVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNRKRPAATKKAGQAKKKKGSYPYDVPDYAYPYDVPDYAYPYDVPDYA

SEQ ID NO: 46 - protein, 1251 aa, Butyrivibrio sp. NC3005
MYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLLKRPAATKKAGQAKKKKGSYPYDVPDYAYPYDVPDYAYPYDVPDYA

SEQ ID NO: 47 - protein, 1262 aa, Eubacterium rectale
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 48 - protein, 1263 aa, Eubacterium rectale
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKEEKTQVIKLFSRFATSFKDYFKNRANCFSADDISSSSCHRIVNDNAEIFFSNALVYRRIVKNLSNDDINKISGDMKDSLKEMSLDEIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNGYNLDKIYIVSRFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCRDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKENDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPEKLKNVGHQCGCIFYVPAAYTSKIDPTTGFANIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 49 - protein, 1263 aa, Eubacterium rectale
MNNGTNNFQNFIGISSLQKTLRNALTPTETTQQFIVKNGIIKEDELRGENRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKEEKTQVIKLFSRFATSFKDYFKNRANCFSADDISSSSCHRIVNDNAEIFFSNALVYRRIVKNLSNDDINKISGDMKDSLKKMSLEKIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPEKKIIEGNTSENKGDYKKMIYNLLPGPNKMIPKVFLSSKTGVETYKPSAYILEGYKQNKHLKSSKDFDITFCRDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDVVLKLNGEAEIFFRKSSIKNPIIHKKGSILVNRTYEAEEKDQFGNIQIVRKTIPENIYQELYKYFNDKSDKELSDEAAKLKNAVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPEKLKNVGHQCGCIFYVPAAYTSKIDPTTGFVNIFKFKDLTVDAKREFIKKFDSIRYDSDKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRNYDRLISPVLNENNIFYDSAKAGDALPKDADANGAYCIALKGLYEIKQITENWKEDGKFSRDKLKISNKDWFDFIQNKRYL

SEQ ID NO: 50 - protein, 1263 aa, Eubacterium sp.
MNNGTNNFQNFIGISSLQKTLRNALIPTETTQQFIVKNGIIKEDELRGKNRQILKDIMDDYYRGFISETLSSIDDIDWTSLFEKMEIQLKNGDNKDTLIKEQAEKRKAIYKKFADDDRFKNMFSAKLISDILPEFVIHNNNYSASEKKEKTQVIKLFSRFATSFKDYFKNRANCFSADDISSSSCHRIVNDNAEIFFSNALVYRRIVKNLSNDDINKISGDMKDSLKEMSLEEIYSYEKYGEFITQEGISFYNDICGKVNSFMNLYCQKNKENKNLYKLRKLHKQILCIADTSYEVPYKFESDEEVYQSVNGFLDNISSKHIVERLRKIGDNYNDYNLDKIYIVSKFYESVSQKTYRDWETINTALEIHYNNILPGNGKSKADKVKKAVKNDLQKSITEINELVSNYKLCSDDNIKAETYIHEISHILNNFEAHELKYNPEIHLVESELKASELKNVLDIIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCHDLIDYFKNCIAIHPEWKNFGFDFSDTSAYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGYALPKDADANGAYCIALKGLYEIKQITENWKEDGKFSRDKLKISNKDWFDFIQNKRYL

SEQ ID NO: 51 - protein, 1340 aa, Lachnospiraceae bacterium MA2020
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 52 - protein, 1437 aa, Lachnospiraceae bacterium NK4A179
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 53 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 54 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 55 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 56 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 57 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 58 - protein, 1051 aa, Unknown
  Listeriaceae bacterium FSL M6-0635 = Listeria newyorkensis FSL M6-0635
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 59 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 60 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 61 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 62 - protein, 1285 aa, Rhodobacter capsulatus; identical to SEQ ID NO: 61

SEQ ID NO: 63 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 64 - protein, 1197 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 65 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 66 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 67 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 68 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 69 - protein, 1373 aa, Eubacteriaceae bacterium
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 70 - protein, 1276 aa, Blautia sp. Marseille-P2398
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 71 - protein, 1385 aa, Leptotrichia sp. oral taxon 879
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 72 - protein, 1334 aa, Lachnospiraceae bacterium NK4A144
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 73 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 74 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 75 - protein, 1235 aa, Thalassospira sp. TSL5-1Thalassospira sp.
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 76 - protein, 1312 aa, Pseudobutyrivibrio sp. OR37
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 77 - protein, 1343 aa, Butyrivibrio sp. YAB3001
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 78 - protein, 1276 aa, Blautia sp. Marseille-P2398; identical to SEQ ID NO: 70

SEQ ID NO: 79 - protein, 1168 aa, Leptotrichia sp. Marseille-P3007
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 80 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 81 - protein, 697 aa, Porphyromonadaceae bacterium KH3CP3RA
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 82 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 83 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 84 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 85 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 86 - protein, 1090 aa, Prevotella sp. P4-76
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 87 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 88 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 89 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 90 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 91 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 92 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 93 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 94 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 95 - protein, 1135 aa, Porphyromonas gingivalis; identical to SEQ ID NO: 94

SEQ ID NO: 96 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 97 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 98 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 99 - protein, 1135 aa, Porphyromonas gingivalis; identical to SEQ ID NO: 98

SEQ ID NO: 100 - protein, 1135 aa, Porphyromonas gingivalis; identical to SEQ ID NO: 97

SEQ ID NO: 101 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 102 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 103 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 104 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 105 - protein, 953 aa, Alistipes sp. ZOR0009
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 106 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 107 - protein, 1322 aa, Prevotella sp. MA2016
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 108 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 109 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 110 - protein, 1157 aa, Myroides odoratimimus; identical to SEQ ID NO: 109

SEQ ID NO: 111 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 112 - protein, 1157 aa, Myroides odoratimimus; identical to SEQ ID NO: 111

SEQ ID NO: 113 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 114 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 115 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 116 - protein, 1224 aa, Bergeyella zoohelcum; identical to SEQ ID NO: 114

SEQ ID NO: 117 - protein, 1155 aa, Flavobacterium sp. 316
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 118 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 119 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 120 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 121 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 122 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 123 - protein, 1145 aa, Chryseobacterium sp. YR477
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 124 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 125 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 126 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 127 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 128 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 129 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 130 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 131 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 132 - protein, 1127 aa, Prevotella buccae; identical to SEQ ID NO: 131

SEQ ID NO: 133 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 134 - protein, 1127 aa, Prevotella sp. MSX73
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 135 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 136 - protein, 1125 aa, Prevotella pallens; identical to SEQ ID NO: 135

SEQ ID NO: 137 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 138 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 139 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 140 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 141 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 142 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 143 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 144 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 145 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 146 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 147 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 148 - protein, 1175 aa, Porphyromonas sp. COT-052 OH4946
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 149 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 150 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 151 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 152 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 153 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 154 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 155 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 156 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 157 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 158 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 159 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 160 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 161 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 162 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 163 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 164 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 165 - protein, 1115 aa, Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 166 - protein, 1111 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 167 - protein, 1110 aa, Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 168 - protein, 668 aa, Fusobacterium necrophorum
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 169 - protein, 1121 aa, Fusobacterium perfoetens
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 170 - protein, 897 aa, Fusobacterium ulcerans
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 171 - protein, 1111 aa, Anaerosalibacter sp. ND1
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 172 - protein, 229 aa, Rattus sp. [sequence omitted]

SEQ ID NO: 173 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 174 - protein, 325 aa, Homo sapiens
MELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 175 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 176 - protein, 200 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPYLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLLD

SEQ ID NO: 177 - protein, 181 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILL

SEQ ID NO: 178 - protein, 7 aa, Simian virus 40
PKKKRKV

SEQ ID NO: 179 - protein, 16 aa, Artificial Sequence
  Synthetic
KRPAATKKAGQAKKKK

SEQ ID NO: 180 - protein, 9 aa, Homo sapiens
PAAKRVKLD

SEQ ID NO: 181 - protein, 11 aa, Homo sapiens
RQRRNELKRSP

SEQ ID NO: 182 - protein, 38 aa, Homo sapiens
NQSSNFGPMKGGNFGGRSSGPYGGGGQYFAKPRNQGGY

SEQ ID NO: 183 - protein, 42 aa, Homo sapiens
RMRIZFKNKGKDTAELRRRRVEVSVELRKAKKDEQILKRRNV

SEQ ID NO: 184 - protein, 8 aa, Homo sapiens
VSRKRPRP

SEQ ID NO: 185 - protein, 8 aa, Homo sapiens
PPKKARED

SEQ ID NO: 186 - protein, 8 aa, Homo sapiens
PQPKKKPL

SEQ ID NO: 187 - protein, 12 aa, Mus sp.
SALIKKKKKMAP

SEQ ID NO: 188 - protein, 5 aa, Influenza virus
DRLRR

SEQ ID NO: 189 - protein, 7 aa, Influenza virus
PKQKKRK

SEQ ID NO: 190 - protein, 10 aa, Hepatitus D virus
RKLKKKIKKL

SEQ ID NO: 191 - protein, 10 aa, Mus sp.
REKKKFLKRR

SEQ ID NO: 192 - protein, 20 aa, Homo sapiens
KRKGDEVDGVDEVAKKKSKK

SEQ ID NO: 193 - protein, 17 aa, Homo sapiens
RKCLQAGMNLEARKTKK

SEQ ID NO: 194 - DNA, 20 bp, Artificial Sequence
  Synthetic
gagtccgagcagaagaagaa

SEQ ID NO: 195 - DNA, 20 bp, Artificial Sequence
  Synthetic
gagtcctagcaggagaagaa

SEQ ID NO: 196 - DNA, 20 bp, Artificial Sequence
  Synthetic
gagtctaagcagaagaagaa

SEQ ID NO: 197 - DNA, 18 bp, Artificial Sequence
  Synthetic
gggggsgggggsgggggs

SEQ ID NO: 198 - DNA, 15 bp, Artificial Sequence
  Synthetic
ggggsggggsggggs

SEQ ID NO: 199 - DNA, 30 bp, Artificial Sequence
  Synthetic
ggggsggggsggggsggggsggggsggggs

SEQ ID NO: 200 - DNA, 45 bp, Artificial Sequence
  Synthetic
ggggsggggsggggsggggsggggsggggsggggsggggsggggs

SEQ ID NO: 201 - DNA, 60 bp, Artificial Sequence
  Synthetic
ggggsggggsggggsggggsggggsggggsggggsggggsggggsggggsggggsggggs

SEQ ID NO: 202 - protein, 12 aa, Artificial Sequence
  Synthetic
FWYHKMILVAGC

SEQ ID NO: 203 - protein, 12 aa, Artificial Sequence
  Synthetic
WYHKREDCSTNQ

SEQ ID NO: 204 - protein, 9 aa, Artificial Sequence
  Synthetic
VCAGSPTND

SEQ ID NO: 205 - protein, 4 aa, Artificial Sequence
  Synthetic
FWYH

SEQ ID NO: 206 - protein, 5 aa, Artificial Sequence
  Synthetic
HKRED

SEQ ID NO: 207 - protein, 4 aa, Artificial Sequence
  Synthetic
GGGS

SEQ ID NO: 208 - protein, 12 aa, Artificial Sequence
  Synthetic
GGGSGGGSGGGS

SEQ ID NO: 209 - protein, 7 aa, Artificial Sequence
  Synthetic
AEAAAKA

SEQ ID NO: 210 - protein, 5 aa, Artificial Sequence
  Synthetic
GGGGS

SEQ ID NO: 211 - protein, 10 aa, Artificial Sequence
  Synthetic
GGGGSGGGGS

SEQ ID NO: 212 - protein, 20 aa, Artificial Sequence
  Synthetic
GGGGSGGGGSGGGGSGGGGS

SEQ ID NO: 213 - protein, 25 aa, Artificial Sequence
  Synthetic
GGGGSGGGGSGGGGSGGGGSGGGGS

SEQ ID NO: 214 - protein, 35 aa, Artificial Sequence
  Synthetic
GGGGSGGGGSGGGGSGGGGSGGGGSGGGGSGGGGS

SEQ ID NO: 215 - protein, 40 aa, Artificial Sequence
  Synthetic
GGGGSGGGGSGGGGSGGGGSGGGGSGGGGSGGGGSGGGGS

SEQ ID NO: 216 - protein, 50 aa, Artificial Sequence
  Synthetic
GGGGSGGGGSGGGGSGGGGSGGGGSGGGGSGGGGSGGGGSGGGGSGGGGS

SEQ ID NO: 217 - protein, 55 aa, Artificial Sequence
  Synthetic
GGGGSGGGGSGGGGSGGGGSGGGGSGGGGSGGGGSGGGGSGGGGSGGGGSGGGGS

SEQ ID NO: 218 - protein, 9 aa, Artificial Sequence
  Synthetic
LAGLIDADG

SEQ ID NO: 219 - DNA, 20 bp, Artificial Sequence
  Synthetic
gccaaattggacgaccctcg

SEQ ID NO: 220 - DNA, 20 bp, Artificial Sequence
  Synthetic
cgaggagacccccgtttcgg

SEQ ID NO: 221 - DNA, 20 bp, Artificial Sequence
  Synthetic
cccgccgccgccgtggctcg

SEQ ID NO: 222 - DNA, 20 bp, Artificial Sequence
  Synthetic
tgagctctacgagatccaca

SEQ ID NO: 223 - protein, 9 aa, Streptococcus pyogenes
WRQLLNAKL

SEQ ID NO: 224 - protein, 9 aa, Streptococcus pyogenes
VITLKSKLV

SEQ ID NO: 225 - protein, 9 aa, Streptococcus pyogenes
ILLSDILRV

SEQ ID NO: 226 - protein, 9 aa, Streptococcus pyogenes
LFDDKVMKQ

SEQ ID NO: 227 - protein, 9 aa, Streptococcus pyogenes
LIHDDSLTF

SEQ ID NO: 228 - protein, 9 aa, Streptococcus pyogenes
LVSDFRKDF

SEQ ID NO: 229 - protein, 9 aa, Streptococcus pyogenes
ILADANLDK

SEQ ID NO: 230 - protein, 9 aa, Streptococcus pyogenes
FLAAKNLSD

SEQ ID NO: 231 - protein, 9 aa, Streptococcus pyogenes
FYSNIMNFF

SEQ ID NO: 232 - protein, 9 aa, Streptococcus pyogenes
FKTEITLAN

SEQ ID NO: 233 - protein, 9 aa, Streptococcus pyogenes
IEKILTFRI

SEQ ID NO: 234 - protein, 9 aa, Streptococcus pyogenes
FFYSNIMNF

SEQ ID NO: 235 - protein, 9 aa, Streptococcus pyogenes
YLASHYEKL

SEQ ID NO: 236 - protein, 9 aa, Streptococcus pyogenes
IYHLRKKLV

SEQ ID NO: 237 - protein, 9 aa, Streptococcus pyogenes
LAHMIKFRG

SEQ ID NO: 238 - protein, 9 aa, Streptococcus pyogenes
ILSARLSKS

SEQ ID NO: 239 - protein, 9 aa, Streptococcus pyogenes
LKALVRQQL

SEQ ID NO: 240 - protein, 9 aa, Streptococcus pyogenes
YKFIKPILE

SEQ ID NO: 241 - protein, 9 aa, Streptococcus pyogenes
FATVRKVLS

SEQ ID NO: 242 - protein, 9 aa, Streptococcus pyogenes
LTLLKALVR

SEQ ID NO: 243 - protein, 9 aa, Streptococcus pyogenes
FYKFIKPIL

SEQ ID NO: 244 - protein, 9 aa, Streptococcus pyogenes
LFKTNRKVT

SEQ ID NO: 245 - protein, 9 aa, Streptococcus pyogenes
MKQLKRRRY

SEQ ID NO: 246 - protein, 9 aa, Streptococcus pyogenes
WGRLSRKLI

SEQ ID NO: 247 - protein, 9 aa, Streptococcus pyogenes
LKRTARRRY

SEQ ID NO: 248 - protein, 9 aa, Streptococcus pyogenes
ARLSKSRRL

SEQ ID NO: 249 - protein, 9 aa, Streptococcus pyogenes
LLFKTNRKV

SEQ ID NO: 250 - protein, 9 aa, Streptococcus pyogenes
IYLALAHMI

SEQ ID NO: 251 - protein, 9 aa, Streptococcus pyogenes
MIKFRGHFL

SEQ ID NO: 252 - protein, 9 aa, Streptococcus pyogenes
FLYLASHYE

SEQ ID NO: 253 - protein, 32 aa, Artificial Sequence
  Synthetic
LEPGEKPYKCPECGKSFSQSGALTRHQRTHTR

SEQ ID NO: 254 - protein, 4 aa, Artificial Sequence
  Synthetic
GGSG

SEQ ID NO: 255 - protein, 7 aa, Artificial Sequence
  Synthetic
ENLYFQG

SEQ ID NO: 256 - protein, 7 aa, Artificial Sequence
  Synthetic
ENLYFQS

SEQ ID NO: 257 - protein, 7 aa, Artificial Sequence
  Synthetic
HPLVGHM

SEQ ID NO: 258 - protein, 15 aa, Artificial Sequence
  Synthetic
GSGGSGGSGGSGGSG

SEQ ID NO: 259 - protein, 5 aa, Artificial Sequence
  Synthetic
APRPG

SEQ ID NO: 260 - protein, 8 aa, Artificial Sequence
  Synthetic
GPLGIAGQ

SEQ ID NO: 261 - protein, 4 aa, Artificial Sequence
  Synthetic
GALA

SEQ ID NO: 262 - protein, 5 aa, Artificial Sequence
  Synthetic
ASSHN

SEQ ID NO: 263 - protein, 6 aa, Artificial Sequence
  Synthetic
KCCYSL

SEQ ID NO: 264 - protein, 7 aa, Artificial Sequence
  Synthetic
YEVGHRC

What is claimed is:

1. A method of reducing immunogenicity of a *S. pyogenes* CRISPR-associated (SpCas9) protein as compared to a naturally occurring SpCas9 protein by mutating one or more immunogenic T cell epitopes in a SpCas9 protein; said method comprising the steps of
determining immunogenicity of the one or more T cell epitopes by measuring affinity of a peptide containing the T cell epitope for one or more MHC molecules, wherein the amino acid sequence of the T cell epitope is chosen from WRQLLNAKL (SEQ TD NO: 223), VITLKSKLV (SEQ ID NO: 224), LFDDKVMKQ (SEQ ID NO: 226), LIHIDDSLTF (SEQ TD NO: 227), LVSDFRKDF (SEQ ID NO: 228), FLAAKNLSD (SEQ ID NO: 230), IEKIL,TFRI (SEQ TD NO: 233), IYIJLRKKLV (SEQ ID NO: 236), LAHIMIKFRG (SEQ ID NO: 237), IL,SARLSKS (SEQ TD NO: 238), LKALVRQQL (SEQ ID NO: 239), YKFIKPIL,E (SEQ ID NO: 240), LTLLKALVR (SEQ ID NO: 242), FYKFIKPIL, (SEQ ID NO: 243), LFKTNRKVT (SEQ TD NO: 244), MKQLKRRRY (SEQ ID NO: 245), WGRLSRKLI (SEQ ID NO: 246), ARLSKSRRL (SEQ ID NO: 248), IYLALAHMI (SEQ ID NO: 250), MIKFRGHFL (SEQ ID NO: 251), or FLYLASHYE (SEQ ID NO: 252),
ordering the T cell epitopes of the SpCas9 protein based on immunogenicity;
mutating one or more of the most immunogenic T cell epitopes;
determining for the reduced immunogenicity SpCas9 protein, Cas-crRNA complex formation and binding to a PAM-containing target; and
if the reduced immunogenicity SpCas9 protein can bind to a PAM-containing target, performing phage-assisted continuous evolution (PACE) to restore or improve Cas-crRNA complex formation and binding to a PAM-containing target of the reduced immunogenicity SpCas9 protein.

2. The method of claim 1, which comprises mutating the SpCas9 proteins containing one or more mutations at one or more amino acid positions and screening the mutant proteins for one or more Cas activities.

3. The method of claim 1, wherein nuclease activity of the SpCas9 protein is preserved.

4. The method of claim 1, wherein one or more catalytically active site residues of the SpCas9 protein are unchanged.

5. The method of claim 1, wherein one or more residues that determine complex formation with a guide are unchanged.

6. The method of claim 1, wherein target specificity of a CRISPR system comprising the SpCas9 protein is maintained or increased.

7. The method of claim 1, which comprises deleting, inserting, or mutating one or more amino acids in the immunogenic T cell epitope.

8. The method of claim 1, wherein identification of a T cell epitope comprises determining the sequence of one or more peptides from the SpCas9 protein that bind to an MHC receptor; or comparison of the CRISPR protein to a database of peptides that bind to an MHC receptor.

9. The method of claim 8, wherein the comparison is in silico.

10. The method of claim 1, wherein the MHC receptor is a class II MHC receptor.

11. The method of claim 1, wherein the SpCas9 protein is associated with a functional domain.

12. The method of claim 11, wherein the functional domain comprises:
a mutation that reduces immunogenicity;
an activator, a repressor, or a DNA methylase; or
a base editor.

13. The method of claim 1, wherein in the PACE step the selection phage (SP) encodes a catalytically dead mutant of the reduced immunogenicity SpCas9 protein, wherein the SpCas9 protein is fused to the ω subunit of bacterial RNA polymerase, and wherein the accessory plasmid (AP) encodes an sgRNA and a PAM and protospacer upstream of the M13 phage gene III, whereby mutations in the reduced immunogenicity SpCas9 protein restore or improve Cas-crRNA complex formation and binding to the PAM-containing target causing increased gene III expression.

14. The method of claim 1, wherein ten or more of the most immunogenic T cell epitopes are mutated.

* * * * *